United States Patent 10,947,530 (ADENOSINE NUCLEOBASE EDITORS AND USES THEREOF) - sequence listing, part 2

SEQ ID NO: 315 - protein, 1329 aa, Enterococcus faecium
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGDLDTENTSIEESFRVFLEQYSKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTKAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAQIFGIEKAFNASYSTYHDFMKLAKTNEWLEQPEMEPIFEDIVKILTIFEDRQMIKHQLSKYQEVFGEKLLKEFARKHYTGWGRFSAKLIHGIRDRKTNKTILDYLIDDDVPANRNRNLMQLINDEHLSFKEEIAKATVFSKHKSLVDVIQDLPGSPAIKKGIWQSLKIVEELIAIIGYKPKNIVIEMARENQKTHRTSPRLKALENGLKQIGSTLLKEQPTDNKALQKERLYLYYLQNGRDMYTGEPLEIENLHQYEVDHIIPRSFIVDNSIDDKVLVASKQNQKKRDDVPKKQIVNEQRIFWNQLKEAKLISTKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKEKGFPQVTEFIKLPKYTLFEFDNGRRRFLASKESQKGNPFILSDQLVTLLYHAQHYDKITYQESFDYVNTHLSDFSAILTEVLAFAEKYTLADKNIERIQELYEENKYGETSMIAQSFLQLLQFNAIGAPADFKFFGVTIPRKRYTSLTEIWDATIIYQSVTGLYETRIRMGDLWAGEQ

SEQ ID NO: 316 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVIALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 317 - protein, 1329 aa, Enterococcus faecium
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKGDLRLVYLALAHLLKYRGHFLFEGDLDTENTSIEESFRVFLEQYGKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTQAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLFYQKYMIFNELTKVSYKDERGVKQYFSGDEKQQIFKQLFQKERGKITVKKLQNFLYTHYHIENAQIFGIEKAFNASYSTYHDFMKLAKTNEWLEQPEMEPIFEDIVKILTIFEDRQMIKHQLSKYQEVFGEKLLKEFARKHYTGWGRFSAKLIHGIRDRKTNKTILDYLIDDDVPANRNRNLMQLINDEHLSFKEEIAKATVFSKHKSLVDVIQDLPGSPAIKKGIWQSLKIVEELIAIIGYKPKNIVIEMARENQKTHRTKPRLKALENGLKQIGSTLLKEQPTDNKALQKERLYLYYLQNGRDMYTGEPLEIENLHQYEVDHIIPRSFIVDNSIDNKVLVASKQNQKKRDDVPKKQIVNEQRIFWNQLKEAKLISPKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTKAIEGITIMEQAAFEKDPTTFLKDKGFPQVTEFIKLPKYTLFEFDNGRRRFLASKESQKGNPFILSDQLVTLLYHAQHYDKITYQESFDYVNTHLSDFSAILTEVLAFAEKYTLADKNIERIQELYEENKYGEISMIAQSFLQLLQFNAIGAPADFKFFGVTIPRKRYTSLTEIWDATIIYQSVTGLYETRIRMGDLWAGEQ

SEQ ID NO: 318 - protein, 1329 aa, Enterococcus faecium
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGDLDTENTSIEESFRVFLEQYSKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTKAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAQIFGIEKAFNASYSTYHDFMKLAKTNEWLEQPEMEPIFEDIVKILTIFEDRQMIKHQLSKYQEVFGEKLLKEFARKHYTGWGRFSAKLIHGIRDRKTNKTILDYLIDDDVPANRNRNLMQLINDEHLSFKEEIAKATVFSKHKSLVDVIQDLPGSPAIKKGIWQSLKIVEELIAIIGYKPKNIVIEMARENQKTHRTSPRLKALENGLKQIGSTLLKEQPTDNKALQKERLYLYYLQNGRDMYTGEPLEIENLHQYEVDHIIPRSFIVDNSIDNKVLVASKQNQKKRDDVPKKQIVNEQRIFWNQLKEAKLISPKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKEKGFPQVTEFIKLPKYTLFEFDNGRRRFLASKESQKGNPFILSDQLVTLLYHAQHYDKITYQESFDYVNTHLSDFSAILTEVLAFAEKYTLADKNIERIQELYEENKYGETSMIAQSFLQLLQFNAIGAPADFKFFGVTIPRKRYTSLTEIWDATIIYQSVTGLYETRIRMGDLWAGEQ

SEQ ID NO: 319 - protein, 1329 aa, Enterococcus faecium
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGDLDTENTSIEESFRVFLEQYGKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTQAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAQIFGIEKAFNASYSTYHDFMKLAKTNEWLEQPEMEPIFEDIVKILTIFEDRQMIKHQLSKYQEVFGEKLLKEFARKHYTGWGRFSAKLIHGIRDRKTNKTILDYLIDDDVPANRNRNLMQLINDEHLSFKEEIAKATVFSKHKSLVDVIQDLPGSPAIKKGIWQSLKIVEELIAIIGYKPKNIVIEMARENQKTHRTKPRLKALENGLKQIGSTLLKEQPTDNKALQKERLYLYYLQNGRDMYTGEPLEIENLHQYEVDHIIPRSFIVDNSIDNKVLVASKQNQKKRDDVPNKQIVNEQRIFWNQLKEAKLISPKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKDKGFPHVTEFIKLPKYTLFEFDNGRRRFLASKESQKGNPFILSDQLVTLLYHAQHYDKITYQESFDYVNTHLSDFSAILTEVLAFAEKYTLADKNIERIQELYEENKYGEISMIAQSFLQLLQFNAIGAPADFKFFGVTIPRKRYTSLTEIWDATIIYQSVTGLYETRIRMGDLWAGEQ

SEQ ID NO: 320 - protein, 1324 aa, Enterococcus italicus
MKNDYTIGLDIGTNSVGYSVVTDDYKVISKKMNVFGNTEKKSIKKNFWGVRLFESGQTAQEARMKRTSRRRIARRKNRICYLQEIFQPEMNHLDNNFFYRLNESFLVADDAKYDKHPIFGTLDEEIHFHEQFPTIYHLRKYLADGDEKADLRLVYLAIAHIIKFRGNFLIEGELNTENNSVIELSKVFVQLYNQTLSELEFIDESIDFSEVLTQQLSKSERADNVLKLFPDEKGTGIFAQFIKLIVGNQGNFKKVFQLEEDQKLQLSTDDYEENIENLLAIIGDEYGDIFVAAQNLYQAILLAGILTSTEKTRAKLSASMIQRYEEHAKDLKLLKRFVKEHIPDKYAEIFNDATKNGYAGYIDGKTKEEEFYKYLKTTLVQKSGYQYFIEKIEQENFLRKQRIYDNGVIPHQVHAEELRAILRKQEKYYSFLKENHEKIEQIFKVRIPYYVGPLAKHNEQSRFAWNIRKSDEPIRPWNMNDVVDENASAVAFIERMTIKDIYLNENVLPRHSLIYEKFTVFNELTKVLYADDRGVFQRFSAEEKEDIFEKLFKSERKVTKKKLENYLRIELSISSPSVKGIEEQFNANFGTYLDLKKFDELHPYLDDEKYQDTLEEVIKVLTVFEDRSMIQNQLEQLPLNLSTKTIKALSRRKYTGWGRLSARLIDGIHDKNSGKTILDYLIDESDSYIVNRNFMQLINDDHLSFKKIIEDSQPYKEQQSAEEIVSELSGSPAIKKGILQSLKIVDELVAIMGYKPKNIVVEMARENQTTGRGKQNSKPRLKGIENGLKEFSDSVLKGSSIDNKQLQNDRLYLYYLQNGKDMYTGHELDIDHLSTYDIDHIIPQSFLTDNSIDNRVLTTSKSNRGKSDNVPSEEVVRKMDRFWRKLLNAKLISERKYTNLTKKELTESDKAGFLKRQLVETRQITKHVATILDSKFNEDSNNRDVQIITLKSALVSEFRKTFNLYKVREINDLHHAHDAYLNAVVALSLLRVYPQLKPEFVYGEYGKNSIHDQNKATIKKQFYSNITRYFASKDIINDDGEILWNKQETIAQVIKTLGMHQVNVVKKVEIQKGGFSKESIQPKGESQKLIRRKQQWNTKKYGGFDSPVVAYAILLSFDKGKRKARSFKIVGITIQDRESFEGNPILYLSKKDYHNPKVEAILPKYSLFEFENGRRRMVASSETQKGNQLIIPGHLMELLYHSKKIINGKNSDSVSYIQNNKEKFREIFEYIVDFSSKYISADANLNKIEKIFENNFHKASEQEIAKSFINLLTFTAMGAPADFEFFGEKIPRKRYVSISEIIDAVFIHQSITGLYETRVRLTEV

SEQ ID NO: 321 - protein, 1323 aa, Enterococcus mundtii
MEKEYTIGLDIGTNSVGWAVLTDDYRLVARKMSIQGDSNRKKIKKNFWGARLFEEGKTAQFRRIKRTNRRRIARRRQRVLALQDIFAEEIHKKDPNFFARLEEGDRVEADKRFAKFPVFATLSEEKNYHRQYPTIYHLRHDLANSKEQADIRLVYLAIAHCLKYRGHFLFEGELDTENTSVTENYQQFLQAYQQFFPEPIGDLDDAVPILTERLSKAKRVEKVLAYYPSEKSTGNFAQFLKLMVGNQANFKKTFDLEEEMKLNFTRDCYEEDLNELLEKTSDDYAELFLKAKGVYDAILLSQILSKSDDETKAKLSANMKLRFEEHQRDLKQLKELVRRDLPKKYDDFFKNRSKNGYAGYVKGKATQEDFYKFLRTELAGLEESQSIMEKIDLEIYLLKQRTFANGVIPHQIHLVEMREIMDRQKRFYPFLKGAQGKIEKLLTFRIPYYVGPLAQEGQSPFAWIKRKSPSQITPWNFAEVVDKENSAIEFIERMTNQDTYLPKEKVLPKQSLIYQRFMIFNELTKVSYTDERGKSHYFSSEQKRKIFNELFKQHPRVTEKQLRKFLELNEQIDSTEIKGIETSFNASYSTYHDLLKLSTLLDDPDMTTMFEEIIKILTIFEDREMIREQLKPYETVLGLPAIKKLAKKHYTGWGRLSEKMIQGMREKQSRKTILDYLIDDDFPCNRNRNFMQLINDDHLSFKETIANELIMSDSNVLLDQVKAIPGSPAVKKGIWQSIKIVEEIIGIIGKAPKNIVIEMARENQRTSRSRPRLKALEEALKNIDSPLLKDYPTDNQALQKDRLYLYYLQNGKDMYTGEPLEIHRLSEYDIDHIIPRSFIVDNSLDNKVLVSSKVNRGKLDNAPDPLVVKRMRSHWEKLHQAKLISDKKLANLTKQNLTEADKARFIQRQLVETRQITKHVANLLHQHFNLPEEVSATEKTSIITLKSTLTSQFRQMFDIYKVREINHHHHAHDAYLNGVVAMTLLKKYPKLAPEFVYGSYIKGDINQINKATAKKEFYSNIMKFFESEEIICDEQGEVIWNKKRDLSTIKKTIGAHQVNIVKKVEKQKGGFYKETINSKANPEKLIPRKASLDPLKYGGYGSPLVAYTVIFIFEKGKQKKVTKGIEGITVMEQLRFEQDPREFLKTKGYEGVKQWLILPKYILFEAQGGYRRMIASQETQKANSLILPENLVTLLYHARHYDEINHKVSFDYVNAHKEGFNDIFDFISDFGVRYILAPQHLEKIKVAYEKNKEVDLKEMIDAILSLLKFTLFGASVEFKFFDIKILKRYKSLTDIWEATIIYQSVTGLYERRVEVRKLWDGER

SEQ ID NO: 322 - protein, 1330 aa, Enterococcus phoeniculicola
MKKEYTIGLDIGTNSVGWAVLTENYDLVKKKMKVYGNTETKYLKKNLWGVRLFDEGETAADRRLKRTTRRRYSRRRNRICRLQDLFTEEMNQVDANFFHRLQESFLVPDEKEFERHAIFGKMEEEVSYYREFPTIYHLRKHLADTSEQADLRLVYLALAHIVKYRGHFLIEGELNTENSSVSETFRTFIQVYNQIFRENEPLAVPDNIEELFSEKVSRARKVEAILSVYSEEKSTGTLAQFLKLMVGNQGRFKKTFDLEEDGIIQIPKEEYEEELETLLAIIGDEYAEIFSATKSVYDAVALSGILSVTDGDTKAKLSASMVERYEAHQKDLVQFKQFIRKELPEMYAPIFRDNSVSGYAGYVENSVTQAEFYKYIKKAIEKVPGAEYFLEKIEQETFLDKQRTFNNGVIPHQIHLEELEAIIQKQATYYPFLADNKEEMKQLVTFRIPYYVGPLADGNSPFAWLERISSEPIRPGNLAEVVDIKKSATKFIERMTNFDTYLPTEKVLPKHSMIYEKYMVYNELTKVSYVDERGMNQRFSGEEKKQIVEELFKQSRKVTKKLLEKFLSNEFGLVDVAIKGIETSFNAGYGTYHDFLKIGITREQLDKEENSETLEEIVKILTVFEDRKMIREQLKKYTYLFDEEVLKKLERRHYTGWGRLSAKLLIGIKEKRTHKTILDYLIDDGGKQPINRNLMQLINDSDLSFKSEIAEAQSDMNTEDLHEVVQNLAGSPAIKKGILQSLKIVDELVDIMGSLPKNIVVEMARENQTTSRGRTNSNPRMKALEEAMRNLRSNLLKEYPTDNQALQNDRLYLYYLQNGKDMYTGLDLSLHNLSSYDIDHIVPQSFTTDNSLDNRVLVSSKENRGKKDDVPSKEVVQKNITLWETLKNSNLISQKKYDNLTKGLRGGLTEDDRAHFIKRQLVETRQITKHVARILDQRFNSQKDEEGKTIRAVRVVTLKSSLTSQFRKQFAIHKVREINDYHHGHDAYLNGVVANSLLRVYPQLQPEFVYGDYPKFNAYKANKATAKKQLYTNIMKFFAEDAVIIDENGEILWDKKNIATVKKVMSYPQMNIVKKPEIQTGSFSKETIKPKGDSDKLISRKTNWSPKLYGGFDSPQVAYSVIITYEKGKKKVRAKAIVGITIMEQSLFKKDPVSLLEEKGYANPEVLIHLPKYTLYELENGRRRLLASANEAQKGNQLVLPASLVTLLYHAKQVDEDSGKSEEYVREHRAEFAEILNYVQAFSETKILANKNLQTILKLYEENKEADIKEIAESFVNLMKFSAYGAPMDFKFFGKTIPRSRYTSVGELLSATIINQSITGLYETRRKLVD

SEQ ID NO: 323 - protein, 1327 aa, Enterococcus sp. AM1
MGKEYTIGLDIGTNSVGWAVLQEDLDLVRRKMKVYGNTEKNYLKKNFWGVDLFDEGMTAKDTRLKRTTRRRYFRRRQRISYLQTFFQEEMNRIDPNFFNRLDESFLIEEDKLSERHPIFGTIEEEVAYHKNYATIYHLRKELADAEEKADLRLVYLALAHIIKYRGHFLIEGRLSTENTSTEETFKTFLQKYNQTFNPVDETISIGSIFADKVSRAKKAEGVLALFPDEKRNGTFDQFLKMIVGNQGNFKKTFELEEDAKLQFSKEEYDESLEALLGEIGDEYADVFEAAKNVYNAVELSGILTVTDNSTKAKLSASMIKRYEDHKTDLKLFKEFIRKNLPEKYHEIFNDKNTDGYAGYIDNSTSQEKFYKYITNLIEKIDGAEYFLKKIENEDFLRKQRTFDNGIIPHQIHLEELKAILHHQAMYYPFLQEKFSNFVDLLTFRIPYYVGPLANGNSRFSWLSRKSDEPIRPWNLAEVVDLSKSAELFIERMTNFDLYLPSEKVLPKHSMLYEKYTVYNELTKVTYKDEQGKVQNFSSEEKERIFIDLFKQHRKVTKKDLSNFLRNEYNLDDVIIDGIENKFNASFNTYHDFLKLKIDPKVLDDPANEPMFEEIVKILTIFEDRKMLREQLSKFSDRLSEKTIKDLERRHYTGWGRLSAKLINGIHDKQSNKTILDYLIDDAPKKNINRNFMQLINDNRLTFKEEIEKEQLKANSEESLIEIVQNLAGSPAIKKGIFQSLKIVDELVEIMGYAPTNIVVEMARENQTTANGRRNSRPRLKNLEKAIDDLDSEILKKHPVDNKALQKDRLYLYYLQNGKDMYTNEELDIHKLSTYDIDHIIPQSFIVDNSLDNRVLVSSSKNRGKLDDVPSKEVVKKMRAFWESLYRSGLISKKKFDNLVKAESGGLSEDDKAGFIHRQLVETRQITKNVARILHQRFNSEKDEEGNLIRKVRIITLKSALTSQFRKNYGIYKIREINDYHHAHDAYLNGVVATALLKIYPQLEPEFVYGEFHRFNAFKENKATAKKQFYSNLMEFSKSDKVIIDENGEILWNQKKIVTVKKVMNYRQMNIVKKVEIQKGGFSKESILPKGDSDKLISRKKEWDTTKYGGFDSPNVAYSVVIRYEKGKTRKLVKTIVGITIMERAAFEKNEREFLKNKGYQNPQICMKLPKYSLYEFDDGRRRLLASAKEAQKGNQMVLPAHLVTFLYHAKHCNEKPDSLKYVTEHQSGFSEIMAHVKDFAEKYTLVDKNLEKILSLYAKNMDSEVKEIAQSFVDLMQLNAFGAPADFKFFGETIPRKRYTSVNELLEATIINQSITGLYETRRRLGD

SEQ ID NO: 324 - protein, 1332 aa, Enterococcus villorum
MNKAYTLGLDIGTNSVGWAVVTDDYRLMAKKMPVHSKMEKKKIKKNFWGARLFDEGQTAEERRNKRATRRRLRRRKYRILELQKIFSEEILKKDSHFFARLDESFLIPEDKQYARFPIFPTLLEEKAYYQNYPTIYHLRQKLADSTEKADIRLVYLALAHMIKYRGHFLFEGELDTENTSVEETFKEFIDIYNEQFEEGIIFYKDIPLILTDKLSKSKKVEKILQYYPKEKTTGCLAQFLKLIVGNQGNFKQAFHLDEEVKIQISKETYEEDLEKLLRKSNEEMIDVFLQVKKVYDAILLSDILSTKMKDTKAKLSAGMIERYQNHKKDLEELKQFVRAHLHEKVTVFFKDSSKDGYAGYIDGKTTQADFYKFLKKELTGVPGSEPMLAKIDQENFLLKQRTPTNGVIPHQVHLTEFKAIIDQQKQYYPFLEKSKEKMIQLLTFRIPYYVGPLAQDKETSSFAWLERKTTEKIKPWNAKDVIDYGASATKFIQRMINYDTYLPTEKVLPKYSMLYQKYTIFNELTKVAYKDDRGIKHQFSSEEKLRIFQELFKKQRRVTKKKLQHFLSANYNIEDAEILGVDKVFNSSYATYHDFLELAKPYELLEQPEMEEMFEDIVKIITIFEDREMVRTQLKKYQRILGEEIFKKLVKKKYTGWGRLSKRLINGIRDQKTNKTILDYLIDDDFPYNRNRNFMQLINDDHLSFKEEIAKELTLSDKQSLLEVVEAIPGSPAIKKGIWQTLKIVEELIAIIGYKPKNIVIEMARENQTTTGGKNRSKPRLKSLEEALKNFDSQLLKERPVDNQSLQKDRLYLYYLQNGKDMYTGESLDIDRLSEYDIDHIIPRSFIVDHSLDNKVLVSSKENRLKKDDVPDSKVVKRMKAYWEKLLRANLISERKFSYLTKLELTDDDKARFIQRQLVETRQITKHVAAILHQYFNQTQELEKEKDIRIITLKSSLVSQFRQVFGIHKVREINHHHHAHDAYLNAVVALALLKKYPRLAPEFVYGSFAKFHLVKENKATAKKEFYSNILKFFEKEEQFCDENGEIFWDKRKHIQQIKKVISSHQVNIVKKVEVQTGSFYKETVNTKEKPDKLIKRKNNWDVTKYGGFGSPVVAYAVVFTYEKGKNHKKAKAIEGITIMEQALFEKDPISFLIEKGYSNVNQFIKLPKYTLFELANGQRRMLASQELQKANSFILPEKLVTLLYHANHYDEIAYKDSYDYVNEHFSNFQDILDKVIIFAEKYTSAPQKLNQIIATYEKNQEADRKIMAHSFVNLMQFNALGAPADFKFFDTTITRKRYTSLTEIWQSTIIYQSVTGLYETRRRMADLWDGVQ

SEQ ID NO: 325 - protein, 1359 aa, Artificial Sequence
  Synthetic Polypeptide
ADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 326 - protein, 1300 aa, Kandleria vitulina
NNKIYNIGLDIGDASVGWAVVDEHYNLLKRHGKHMWGSRLFTQANTAVERRSSRSTRRRYNKRRERIRLLRGIMEDMVLDVDPTFFIRLANVSFLDQEDKKDYLKSNYNLFIDKDFNDKTYYDKYPTIYHLRKHLCESKEKEDPRLIYLALHHIVKYRGNFLYEGQKFSMDVSNIEDKMIDVLRQFNEINLFEYVEDKKIDEVLNVLKEPLSKKHKADKAFALFDTTKDNKAAYKELCAALAGNKFNVTKMLKEAELHDEDEKDISFKFSDATFDDAFVEKQPLLGDCVEFIDLLHDIYSWVELQNILGSAHTSEPSISAAMIQRYEDHKNDLKLLKDVIRKYLPKKYFEVFRDEKSKKNNYCNYINHKTPVDEFYKYIKKLIEKIDDPDVKTILNKIELESFMLKQNSRTNGAVPYQMQLDELNKILENQSVYYSDLKDNEDKIRSILTFRIPYYFGPLITKDRQFDWIIKKEGKENERILPWNANEIVDVDKTADEFIKRMRNFCTYFPDEPVLAKNSLTVSKYEVLNEINKLRINDHLIKRDIKDKMLHTLFMDHKSISANAMKKWLVKNQYFSNTDDIKIEGFQKENACSTSLTPWIDFTKIFGEINNSNYELIEKIIYDVTVFEDKKILRRRLKKEYDLDEEKIKKILKLKYSGWSRLSKKLLSGIKTKRTPETVLEVMETNMNLMQVINDEKLGFKKTIDDANSTSVSGKFSYAEVQELAGSPAIKRGIWQALLIVDEIKKIMKHEPAHVYIEFARNEDKERKDSFVNQMLKLYKDFEDEANKHLKGEDAKSKIRSERLKLYYTQMGKCMYTGKSLDIDRLDTYQVDHIVPQSLLKDDSIDNKVLVLSSENQRKLDDLVIPEMIRNKMFGFWNKLYENKIISPKKFYSLIKSEYSDKDKERFINRQIVETRQITKHVAQIISNHYETTKVVTVRADLSHAFRERYHIYKNRDINDFHHAHDAYIATILGTYIGHRFESLDAKYIYGEYQKIFRNKNKDKKDGFILNSMRNLYADKDTGEVVWDPEWISRIKKCFYYKDCFVTKKLEENNGSFFNTVRPNDEHSEKGAKVPVNKLRSNVHKYGGFEGLKYSIVAIKGKKKKGKKIIDVNKLVGIPLMYKNVDDETKINYIKESEGLEEVKIIKEILKNQLIEINGGLFYVTSEIVNARQLILDFNCTRIIDGIYKAMKYKNYSELSQEEIMNVYDIFVEKLKLYYPTYKNIATNFENFENISDEEKCEVIQMLVVMHAGPQNGNITFDDFKLSNRLGRLNCKTISLTTVFIADSPTGMYSKKYKL

SEQ ID NO: 327 - protein, 1301 aa, Kandleria vitulina
NNKIYNIGLDIGDASVGWAVVDEHYNLLKRHGKHMWGSRLFTQANTAVERRSSRSTRRRYNKRRERIRLLREIMEDMVLDVDPTFFIRLANVSFLDQEDKKDYLKSNYNLFIDKDFNDKTYYDKYPTIYHLRKHLCESKEKEDPRLIYLALHHIVKYRGNFLYEGQKFSMDVSNIEDKMIDVLRQFNEINLFEYVEDKKIDEVLNVLKEPLSKKHKAEKAFALFDTTKDNKAAYKELCAALAGNKFNVTKMLKEAELHDEDEKDISFKFSDATFDDAFVEKQPLLGDCVEFIDLLHDIYSWVELQNILGSAHTSEPSISAAMIQRYEDHKNDLKLLKDVIRKYLPKKYFEVFRDEKSKKNNYCNYINHKTPVDEFYKYIKKLIEKIDDPDVKTILNKIELESFMLKQNSRTNGAVPYQMQLDELNKILENQSVYYSDLKDNEDKIRSILTFRIPYYFGPLITKDRQFDWIIKKEGKENERILPWNANEIVDVDKTADEFIKRMRNFCTYFPDEPVMAKNSLTVSKYEVLNEINKLRINDHLIKRDMKDKMLHTLFMDHKSISANAMKKWLVKNQYFSNTDDIKIEGFQKENACSTSLTPWIDFTKIFGKINESNYDFIEKIIYDVTVFEDKKILRRRLKKEYDLDEEKIKKILKLKYSGWSRLSKKLLSGIKTKRTPETVLEVMETNMNLMQVINDEKLGFKKTIDDANSTSVSGKFSYAEVQELAGSPAIKRGIWQALLIVDEIKKIMKHEPAHVYIEFARNEDKERKDSFVNQMLKLYKDFEDEANKHLKGEDAKSKIRSERLKLYYTQMGKCMYTGKSLDIDRLDTYQVDHIVPQSLLKDDSIDNKVLVLSSENQRKLDDLVIPSSIRNKMYGFWEKLFNNKIISPKKFYSLIKTEFNEKDQERFINRQIVETRQITKHVAQIIDNHYENTKVVTVRADLSHQFRERYHIYKNRDINDFHHAHDAYIATILGTYIGHRFESLDAKYIYGEYKRIFRQKNKGKNDGFILNSMRNIYADKDTGEIVWDPNYIDRIKKCFYYKDCFVTKKLEENNGTFFNTVLPNDTNSDKDATVPVNKYRSNVNKYGGFSGVNSFIVAIKGKKKKGKKVIEVNKLTGIPLMYKNADEEIKINYLKQAEDLEEVQIGKEILKNQLIEKDGGLYYIVAEIINAKQLILNESQTKLVCEIYKAMKYKNYDNLDSEKIIDLYRLLINKMELYYPEYRKQLVKKFEDLKVISIEEKCNIIQILATLHCNSSIGKIMYSDFKISTTIGRLNGRTISLDISFIAESPTGMYSKKYKL

SEQ ID NO: 328 - protein, 1304 aa, Lactobacillus animalis
LKKDYSIGLDIGTNSVGHAVVTDDYKVPTKKMKVFGDTSKKTIKKNMLGVLLFNEGQTAADTRLKRGARRRYTRRKNRLRYLQEIFAPALAKVDPNFFYRLEESSLVAEDKKYDVYPIFGKREEELLYHDTHKTIYHLRSELANNDRPADLRLVYLALAHIIKYRGNFLLEGEIDLRTTDINKVFAEFSETLNENSDENLGKLDVADIFKDNTFSKTKKSEELLKLSGKKNQLAHQLFKMMVGNMGSFKKVLGTDEEHKLSFGKDTYEDDLNDLLAEAGDQYLDIFVAAKKVYDAAILASILDVKDTQTKTVFSQAMIERYEEHQKDLIELKRVFKKYLPEKCHDFFSEPKISGYAGYIDGKVSEEDFYKYTKKTLKGIPETEEILQKIDANNYLRKQRTFDNGAIPHQVHLKELVAIVENQGKYYPFLRENKDKFEKILNFRIPYYVGPLARGNSKFAWLTRAGEGKITPYNFDEMIDKETSAEDFIKRMTINDLYLPTEPVLPKHSLLYERYTIFNELAGVRYVTENGEAKYFDAQTKRSIFELFKLDRKVSEKMVIKHLKVVMPAIRIQALKGLDNGKFNASYGTYKDLVDMGVAPELLNDEVNSEKWEDIIKTLTIFEGRKLIKRRLENYRDFLGEDILRKLSRKKYTGWGRLSAKLLDGIYDKKTHKTILDCLMEDYSQNFMQLINDDTYSFKETIKNAQVIEKEETLAKTVQELPGSPAIKKGILQSLEIVDEIIKVMGYKPKSIVVEMARETQTHGTRKREDRVQQIVKNLKELPKPSNAELSDERKYLYCLQNGRDMYTGAPLDYDHLQFYDVDHIIPQSFLKDDSIENKVLTIKKENVRKTNGLPSEAVIQKMGSFWKKLLDAGAMTNKKYDNLRRNLHGGLNEKLKERFIERQLVETRQITKYVAQLLDQRLNYDGNGVELDEKIAIVTLKAQLASQFRSEFKLRKVRALNNLHHAHDAYLNAVVANLIMAKYPELEPEFVYGKYRKTKFKGLGKATAKNTLYANVLYFLKENEVYPFWDKARDLPTIKRYLYRAQVNKVRKAERQTGGFSDEMLVPKSDSGKLLPRKEGLDPVKYGGYAKAVESYAVLITADEVKKGKTKKVKTLVNIPIIDSKKYEADPTAYLASRGYTNVTNSFILPKYSLLEDPEGRRRYLASKEFQKANELILPQHLVELLYWVNAKDGEQKLEDHKAEFKELFDKIMEFADKYVVAPKNSEKIRRLYEENQDATPMELGKNFVELLRYTADGAASDFKFFGENIPRKRYNSAGSLLNGTLIYQSKTGLYETRIDLGKL

SEQ ID NO: 329 - protein, 1292 aa, Lactobacillus curvatus
MSRPYNIGLDIGTSSIGWSVVDDQSKLVSVRGKYGYGVRLYDEGQTAAERRSFRTTRRRLKRRKWRLGLLREIFEPYITPVDDTFFLRKKQSNLSPKDQRKQTSLFNDRTDRAFYDDYPTIYHLRYKLMTEKRQFDIREIYLAMHHIVKYRGHFLNEAPVSSFKSSEINLVAHFDRLNTIFADLFSESGFTDKLAEVKALLLDNHQSASNRQRQALLLIYTPSKQNKAIATELLKAILGLKAKFNVLTGIEAEDVKTWTLTFNAENFDEEMVKLESSLDDNAHQIIESLQELYSGVLLAGIVPENQSLSQAMITKYDDHQKHLKMLKAVREALAPEDRQRLKQAYDQYVDGKSKEDFYGDITKALKNNPDHPIVSEIKKLIELDQFMPKQRTKDNGAIPHQLHQQELDRIIENQQQYYPWLAELNPNKLDELVAFRVPYYVGPLQQQSSDAKFAWMIRKAEGQITPWNFDDKVDRQASANEFIKRMTTTDTYLLAEDVLPKQSLIYQRFEVLNELNGLKIDDQPITTELKQAIFTDLFMQKTSVTVKNIQDYLVSEKRYASRPAITGLSDENKFNSRLSTYHDLKTIVGDAVDDVDKQADLEKCIEWSTIFEDGKIYSAKLNEIDWLTDQQRVQLAAKRYRGWGRLSAKLLTQIVNANGQRIMDLLWTTDNFMRIVHSEDFDKLITEANQMMLAENDVQDVINDLYTSPQNKKALRQILLVVNDIQKAMKGQAPERILIEFAREDEVNPRLSVQRKRQVEQVYQNISELEIRNELKDLSNSALSNTRLFLYFMQGGRDMYTGDSLNIDRLSTYDIDHILPQSFIKDNSLDNRVLVSQRMNRSKADQVPSVELGQKMQIQWEQMLRAGLITKKKYDNLTLNPDMKGFINRQLVETRQVIKLATNLLMEQYGEDNIELITVKSGLTHQMRTEFDFPKNRNLNNHHHAFDAYLTAFVGLYLLKRYPKLKPYFVYGEYQKASQQDKRNFNFLNGLKKDELVDENTEAVIWNKESGLAYLNKIYQFKKILVTREVHENSGALFNQTLYAAKDDKASGQLIPAKQDRPTALYGGYSGKTVAYMCIVRIKNKKGDLYKVCGVETSWLAQLKQKKAFLKQKISPQFTKVKKQKGTIVKVVEDFEVIAPHILINQRFFDNGQELTLGSHNEQELILDKTAVKLLNGALPLTQSEELAEQVYDEILDQVMHYFPLYDTNQFRAKLSAGKAADGNKMVQVGQQVILDRVLIGLHANAAVSDLGVLKISTPLGKMQQPSGISDTQIIYQSPTGLFERRVALRDL

SEQ ID NO: 330 - protein, 1291 aa, Lactobacillus farciminis
KEQPYNIGLDIGTGSVGWAVTNDNYDLLNIKKKNLWGVRLFEGAQTAKETRLNRSTRRRYRRRKNRINWLNEIFSEELANTDPSFLIRLQNSWVSKKDPDRKRDKYNLFIDNPYTDKEYYREFPTIFHLRKELIINKNKADIRLVYLALHNILKYRGNFTYEHQKFNISTLNSNLSKELIELNQQLIKYDISFPDNCDWNHISDILIGRGNATQKSSNILNNFTKETKKLLKEVINLILGNVAHLNTIFKTSLTKDEEKLSFSGKDIESKLDDLDSILDDDQFTVLDTANRIYSTITLNEILNGESYFSMAKVNQYENHAIDLCKLRDMWHTTKNEKAVGLSRQAYDDYINKKKELYTSLKKFLKVALPTNLAKEAEEKISKGTYLVKPRNSENGVVPYQLNKIEMEKIIDNQSQYYPFLKENKEKLLSILSFRIPYYVGPLQSSEKNPFAWMERKSNGHARPWNFDEIVDREKSSNKFIRRMTVTDSYLVGEPVLPKNSLIYQRYEVLNELNNIRITENLKTNPTGSRLTVETKQHIYNELFKNYKKITVKKLTKWLIAQGYYKNPILIGLSQKDEFNSTLTTYLDMKKIFGSSFMENNKNYNQIEELIEWLTIFEDKQILNEKLHSSNYSYTSDQIKKISNMRYKGWGRLSKKILTCITTETNTPKSLQLSNDLMWTTNNNFISIISNDKYDFKNYIENHNLNKNEDQNISNLVNDIHVSPALKRGITQSIKIVQEIVKFMGHAPKYIFIEVTRETKTTSRGKRIQRLQSKLLNKANGLVPEELKKHKNDLSSERIMLYFLQNGKSLYSEESLNINKLSDYQVDHILPRTYIPDDSLENKALVLAKENQRKADDLLLNSNVIDKNLERWTYMLNNNMMGLKKFKNLTRRVITDKDKLGFIHRQLVQTSQMVKGVANILNSMYKNQGTTCIQARANLSTAFRKALELVKNRNINDFHHAQDAYLASFLGTYRLRRFPTDEMLLMNGEYNKFYGKELYSKKSRKNGFIISPLVNGTTQDRNTGEIIWNVGFRDKILKIFNYHQCNVTRKTEIKTGQFYDQTIYSPKNPKKLIAQKKDMDPNIYGGFSGDNKSSITIVKIDNNKIKPVAIPIRLINDKKTLQNWLEENVKHKKSIQIIKNNVPIGQIIYSKKVGLLSREIANRQQLILPPEHSALLRILQIPDEDPDQILAFYDKNILVEILQELITKMKKFYPFYKNEQEFLASFNQATTSEKINSLEELITLLHANSTSAHLIFNNIEKKAFGRKTHGLTDTDFIYQSVTGLYETRIHIE

SEQ ID NO: 331 - protein, 1327 aa, Listeria innocua
MKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 332 - protein, 1327 aa, Listeria innocua
MKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLISRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHVANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 333 - protein, 1327 aa, Listeria innocua; identical to SEQ ID NO: 332

SEQ ID NO: 334 - protein, 1101 aa, Listeria innocua
LKLYPGEKSTGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGTKQADFYKYMKTTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELKNNRLYLYYLQNGKDMYTGQDLDIHNLSNYDIDHIVPQSFITDNSIDNLVLTSSAGNREKGNDVPPLEIVQKRKVFWEKLYQGNLMSKRKFDYLTKAERGGLTEADKARFIHRQLVETRQITKNVANILHQRFNYGKDDHGNTMKQVRIVTLKSALVSQFRKQFQLYKVRGVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 335 - protein, 1327 aa, Listeria ivanovii
MRKPYTIGLDIGTNSVGWAVLTDQYNLVKRKMKVAGSAEKKQIKKNFWGVRLFDEGEVAAGRRMNRTTRRRIERRRNRIAYLQEIFAAEMAEVDANFFYRLEDSFYIESEKRHSRHPFFATIEEEVAYHEEYKTIYHLREKLVNSSDKADLRLVYLALAHIIKYRGNFLIEGMLDTKNTSVDEVFKQFIQTYNQIFASDIERLEENKEVAEILSEKLTRREKLDKILKLYTGEKSTGMFARFINLIIGSKGDFKKVFDLDEKAEIECAKDTYEEDLEALLAKIGDEYAEIFVAAKSTYNAVVLSNIITVTDTETKAKLSASMIERFDKHAKDLKRLKAFFKMQLPEKFNEVFNDIEKDGYAGYIDGTTQEKFYKYMKKMLANIDGADYFIDQIEEENFLRKQRTFDNGTIPHQLHLEELEAILHQQAKYYPFLRKDYEKIRSLVTFRIPYFIGPLANGQSDFAWLTRKADGEIRPWNIEEKVDFGKSAIDFIEKMTNKDTYLPKENVLPKHSLCYQKYMVYNELTKIRYIDDQGKTHHFSGQEKQQIFNGLFKQQRKVKKKDLERFLYTINHIESPTIEGVEDAFNSSFATYHDLQKGGVTQEILDNPLNADMLEEIVKILTVFEDKRMIKEQLQSFSDVLDGTILKKLERRHYTGWGRLSAKLLTGIRDKHSHLTILDYLMDDGLNRNLMQLINDSNLSFKSIIEKEQVSTADKGIQSIVAELAGSPAIKKGILQSLKIVDELVGIMGYPPQTIVVEMARENQTTGKGKNNSKPRFISLEKAIKEFGSQILKEHPTDNQCLKNDRLYLYYLQNGKDMYTGKELDIHNLSNYDIDHIIPQSFITDNSIDNRVLVSSTANREKGDNVPLLEVVRKRKAFWEKLYQAKLMSKRKFDYLTKAERGGLTEADKANFIQRQLVETRQITKNVANILYQRFNCKQDENGNEVEQVRIVTLKSTLVSQFRKQFQLYKVREVNDYHHAHDAYLNGVVANTLLKVYPQLEPEFVYGDYHQFDWFKANKATAKKQFYTNIMRFFAKENQIIDKNGEILWDNRYLDTIKKVLSYRQMNIVKKTEIQKGEFSNATVNPKGNSSKLISRKADWNPIKYGGFDGSNMAYSIVIEYEKRKKKTVIKKELIQINIMERVAFEKDQKAFLEEKGYYSPKVLTKIPKYTLYECENGRRRMLGSANEAQKGNQMVLPNHLMTLLYHAKNCEANDGESLAYIEMHREMFAELLAYISEFAKRYTLANDRLEKINMFFEQNKKGDIKVIAKSFDKLKVFNAFGAPRDFEFFETTIKRKRYYNIKELLNATIIYQSITGLYEARKRLED

SEQ ID NO: 336 - protein, 952 aa, Listeria ivanovii
MKKMLANIDGADYFIDQIEEENFLRKQRTFDNGTIPHQLHLEELEAILHQQAKYYPFLRKDYEKIRSLVTFRIPYFIGPLANGQSDFAWLTRKADGEIRPWNIEEKVDFGKSAIDFIEKMTNKDTYLPKENVLPKHSLCYQKYMVYNELTKIRYIDDQGKTHHFSGQEKQQIFNGLFKQQRKVKKKDLERFLYTINHIESPTIEGVEDAFNSSFATYHDLQKGGVTQEILDNPLNADMLEEIVKILTVFEDKRMIKEQLQSFSDVLDGTILKKLERRHYTGWGRLSAKLLTGIRDKHSHLTILDYLMDDGLNRNLMQLINDSNLSFKSIIEKEQVSTADKGIQSIVAELAGSPAIKKGILQSLKIVDELVGIMGYPPQTIVVEMARENQTTGKGKNNSKPRFISLEKAIKEFGSQILKEHPTDNQCLKNDRLYLYYLQNGKDMYTGKELDIHNLSNYDIDHIIPQSFITDNSIDNRVLVSSTANREKGDNVPLLEVVRKRKAFWEKLYQAKLMSKRKFDYLTKAERGGLTEADKANFIQRQLVETRQITKNVANILYQRFNCKQDENGNEVEQVRIVTLKSTLVSQFRKQFQLYKVREVNDYHHAHDAYLNGVVANTLLKVYPQLEPEFVYGDYHQFDWFKANKATAKKQFYTNIMRFFAKENQIIDKNGEILWDNRYLDTIKKVLSYRQMNIVKKTEIQKGEFSNATVNPKGNSSKLISRKADWNPIKYGGFDGSNMAYSIVIEYEKRKKKTVIKKELIQINIMERVAFEKDQKAFLEEKGYYSPKVLTKIPKYTLYECENGRRRMLGSANEAQKGNQMVLPNHLMTLLYHAKNCEANDGESLAYIEMHREMFAELLAYISEFAKRYTLANDRLEKINMFFEQNKKGDIKVIAKSFDKLKVFNAFGAPRDFEFFETTIKRKRYYNIKELLNATIIYQSITGLYEARKRLED

SEQ ID NO: 337 - protein, 1327 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHDNYRTIYHLREKLVNSSEKADLRLVYLALAHIIKYRGNFLIEGALDTKNTSVDEVYKQFIETYNQVFMSNIEKVEENIEVANILAGKFTRREKFERILQLYPGEKSTGMFAQFISLIVGSKGNFQKVFDLIEKTDIECAKDSYEEDLETLLAIIGDEYAELFVAAKNTYNAVVLSSIITVTDTETNAKLSASMIERFDAHEKDLVELKAFIKLNLPKQYEEIFSNAAIDGYAGYIDGTKQVDFYKYLKTILENIEGSDYFIAKIEEENFLRKQRTFDNGAIPHQLHLEELEAIIHQQAKYYPFLKEDYDKIKSLVTFRIPYFVGPLANGQSEFAWLTRKADGEIRPWNIEEKVDFGKSAVDFIEKMTNKDTYLPKENVLPKHSLCYQKYMVYNELTKIRYIDDQGKTNYFSGREKQQVFNDLFKQKRKVKKKDLELFLRNINHIESPTIEGLEDSFNASYATYHDLLKVGMKQEILDNPLNTEMLEDIVKILTVFEDKPMIKEQLQQFSDVLDGGVLKKLERRHYTGWGRLSAKLLVGIREKQSHLTILDYLMDDGLNRNLMQLINDSNLSFKSIIEKEQVSTTDKDLQSIVAELAGSPAIKKGILQSLKIVDELVSIMGYPPQTIVVEMARENQTTGKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILYQRFNKETDNHGNTMEQVRIVTLKSALVSQFRKQFQLYKVREVNGYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKIVIEKKLIQINIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIKAIAQSFVDLMAFNAMGAPASFKFFEATIDRKRYTNLKELLSSTIIYQSITGLYESRKRLDD

SEQ ID NO: 338 - protein, 1327 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDEVYKQFIQTYNQVFMSNIEKVEENTEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKELGELKAFIKLHLPKQYQEIFNNAEIDGYAGYIDGTKQVDFYKYLKTTLENVEGADYFITKIEEENFLRKQRTFDNGVIPHQLHLEELEAILHQQAKYYPFLREGYDKIKSLVTFRIPYFVGPLANGQSEFAWLTRKDDGEIRPWNIEEKVDFGKSAVDFIEKMTNKDTYLPKENVLPKHSLCYQKYMVYNELTKIRYIDDQGKTNYFSGREKQQIFNDLFKQKRKVKKKDLELFLRNINHIESPTIEGLEDSFNASYATYHDLLKVGLKQEILDNPLNTEILEDIVKILTVFEDKRMIKEQLEQFSDVLDGVVLKKLERRHYTGWGRLSAKLLVGIRDKQSHLTILDYLMDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKDFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQINIVKKTEIQKGEFSKATIKPKGNSSKLIPRKENWDPMKYGGLDSPNMAYAVIIEHAKGKKKIVIEKKLIQINIMERKMFEKDEEAFLEEKGYHQPKVLTKLPKYTLYECEKGRRRMLSSANEAQKGNQLVLSNHLVSLLYHAKNCEASDGKSLKYIEAHRETFSELLAQVSEFATKYTLADANLSKINNLFEQNKEGDIKAIAQSFVDLMAFNAMGAPASFKFFEATIDRKRYTNLKELLSSTIIYQSITGLYESRKRLDD

SEQ ID NO: 339 - protein, 1327 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDEVYKQFIQTYNQVFMSNIEKVEENTEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKELGELKAFIKLHLPKQYQEIFNNAEIDGYAGYIDGTKQVDFYKYLKTTLENVEGADYFITKIEEENFLRKQRTFDNGVIPHQLHLEELEAILHQQAKYYPFLREGYDKIKSLVTFRIPYFVGPLANGQSEFAWLTRKDDGEIRPWNIEEKVDFGKSAVDFIEKMTNKDTYLPKENVLPKHSLCYQKYMVYNELTKIRYIDDQGKTNYFSGREKQQIFNDLFKQKRKVKKKDLELFLRNINHIESPTIEGLEDSFNASYATYHDLLKVGLKQEILDNPLNTEILEDIVKILTVFEDKRMIKEQLEQFSDVLDGVVLKKLERRHYTGWGRLSAKLLVGIRDKQSHLTILDYLMDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKDFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQINIVKKTEIQKGEFSKATIKPKGNSSKLIPRKENWDPVKYGGLDSPNMAYAVIIEHAKGKKKIVIEKKLIQINIMERKMFEKDEEAFLEEKGYHQPKVLTKLPKYTLYECEKGRRRMLSSANEAQKGNQLVLSNHLVSLLYHAKNCEASDGKSLKYIEAHRETFSELLAQVSEFATKYTLADANLSKINNLFEQNKEGDIKAIAQSFVDLMAFNAMGAPASFKFFEATIDRKRYTNLKELLSSTIIYQSITGLYESRKRLDD

SEQ ID NO: 340 - protein, 1327 aa, Listeria monocytogenes
MKKPYTIGLDIGTNSVGWAVLTDQYDLVKRKMKISGDSEKKQIKKNFWGVRLFEKGETAAKRRMSRTARRRIERRRNRISYLQEIFAIQMNEVDDNFFNRLKESFYAESDKKYNRHPFFGTVEEEVAYYKDFPTIYHLRKELIDSQKKADLRLVYLALAHIIKYRGHFLIEGALDTKNTSIDEMFKQFLQIYNQVFANDIEKTEKNQEVAQILAEKFTRKDKLDKILSLYPGEKTTGVFAQFVNIIVGSTGKFKKHFNLHEKKDINCAEDTYDTDLESLLAIIGDEFAEVFVAAKNAYNAVVLSNIITVTDSTTRAKLSASLIERFENHKEDLKKMKRFVRTYLPEKYDEIFDDTEKHGYAGYISGTKQADFYKYMKATLEKIEGADYFIAKIEEENFLRKQRTFDNGVIPHQLHLEELEAILHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINQIESPTIEGLEDSFNASYATYHDLLKVGMKQEILDNPLNTEMLEDIVKILTVFEDKRMIKEQLQQFSDVLDGTVLKKLERRHYTGWGRLSAKLLVGIRDKQSHLTILDYLMDDGLNRNLMQLINDSNLSFKSIIEKEQVSTTDKDLQSIVAELAGSPAIKKGILQSLKIVDELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSVDNLVLTSSAGNREKGDNVPPLEIVQKRKIFWEKLYQGNLMSKRKFDYLTKAERGGLTEADKARFIHRQLVETRQITKNVANILHQRFNYKTDGNKDTMETVRIVTLKSALVSQFRKQFQFYKVREVNDYHHAHDAYLNGVVANTLLKVYPQLEPEFVYGEYHQFGWFKANKATAKKQFYTNIMLFFAQKDRIIDENGEILWDKRYLETVKKVLGYRQMNIVKKTEIQKGEFSNVTPNPKGKSNKLIPRKKDWDPIKYGGFDGSKMAYAIIIEYEKQKRKVRIEKKLIQINIMEREAFEKDEKTFLEEKGYHQPKVLIKVPKYTLYECKNGRRRMLGSANEAHKGNQMLLPNHLMALLYHAEKYEAIDGESLAYIEVHRALFDELLAYISEFARKYTLSNDRLDEINMLYERNKDGDVKSIAESFVSLKKFNAFGVHQDFSFFGTKIERKRDRKLNELLNSTIIYQSITGLYESRKRLDN

SEQ ID NO: 341 - protein, 1327 aa, Listeria monocytogenes
MKNPYTIGLDIGTNSVGWAVLTDQYDLVKRKMKVAGNSDKKQIKKNFWGVRLFDEGETAADRRMNRTARRRIERRRNRISYLQEIFALEMANIDANFFCRLNDSFYVDSEKRNSRHPFFATIEEEVAYHKNYRTIYHLREELVNSSEKADLRLVYLALAHIIKYRGNFLIEGALDTKNTSVDGVYKQFIQTYNQVFISNIEKMEENTTVADILAGKFTRKEKLERILQLYPGEKSTGMFAQFISLIVGSKGNFQKVFDLVEKTDIECAKDSYEEDLEALLAIIGDEYAELFVAAKNTYNAVVLSSIITVTDTETNAKLSASMIERFDAHEKDLSELKAFIKLHLPKQYEEIFSNVAIDGYAGYIDGTKQVDFYKYLKTLLENIEGADYFIAKIEEENFLRKQRTFDNGAIPHQLHLEELEAILHQQAKYYPFLKEAYDKIKSLVTFRIPYFVGPLANGQSDFAWLTRKADGEIRPWNIEEKVDFGKSAVDFIEKMTNKDTYLPKENVLPKHSLYYQKYMVYNELTKVRYIDDQGKTNYFSGQEKQQIFNDYFKQKRKVSKKDLEQFLRNMSHIESPTIEGLEDSFNSSYATYHDLLKVGIKQEVLENPLNTEMLEDIVKILTVFEDKRMIKEQLQQFSDVLDGAVLKKLERRHYTGWGRLSAKLLVGIRDKQSHLTILDYLMDDGLNRNLMQLINDSNLSFKSIIEKEQVSTTDKDLQSIVADLAGSPAIKKGILQSLKIVDELVSIMGYPPQTIVVEMARENQTTVKGKNNSRPRYKSLEKAIKEFGSQILKEHPTDNQELRNNRLYLYYLQNGKDMYTGQELDIHNLSNYDIDHIVPQSFITDNSIDNLVLTSSAGNREKGDDVPPLEIVRKRKVFWEKLFQGNLMSKRKFDYLTKAERGGLTEADKATFIHRQLVETRQITKNVANILHQRFNNETDNHGNNMEQVRIVMLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKVVFEKKIIRITIMERKAFEKDEKSFLEKQGYRQPKVLTKLPKYTLYECENGRRRMLASANEAQKGNQQVLKGQLITLLHHAKNCEASDGKSLDYIESNREMFGELLAHVSEFAKRYTLADANLSKINQLFEQNKDNDIKVIAQSFVNLMAFNAMGAPASFKFFEATIERKRYTNLKELLSATIIYQSITGLYEARKRLDG

SEQ ID NO: 342 - protein, 1327 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEKVEENIEVANILAGKFTRREKFERILQLYPGEKSTGMFAQFISLIVGSKGNFQKVFDLIEKTDIECAKDSYEEDLEALLAIIGDEYAELFVAAKNTYNAVVLSSIITVTATETNAKLSASMIERFDAHEKDLGELKAFIKLHLPKQYQEIFNNAAIDGYAGYIDGTKQVDFYKYLKTILENIEGADYFIAKIEEENFLRKQRTFDNGAIPHQLHLEELEAIIHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINHIESPTIEGLEDSFNASYATYHDLLKVGMKQEILDNPLNTEMLEDIVKILTVFEDKPMIKEQLQQFSDVLDGGVLKKLERRHYTGWGRLSAKLLVGIREKQSHLTILDYLMDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKEFGSKILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTDADKARFIHRQLVETRQITKNVANILHQRFNNETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFGQKERIIDENGEILWDKKYLETIKKVLDYRQMNIVKKTEIQKGEFSKATIKPKGNSSKLIPRKENWDPMKYGGLDSPNMAYAVIIEHAKGKKKLIFEKKIIRITIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIQAIAQSFVDLMAFNAMGAPASFKFFEATIDRKRYTNLKELLSSTIIYQSITGLYESRKRLDD

SEQ ID NO: 343 - protein, 1327 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFILTYNQVFMSNIEKVEENIEVANILAGKFTRREKFERILQLYPGEKSTGMFAQFISLIVGSKGNFQKVFDLIEKTDIECAKDSYEEDLETLLAIIGDEYAELFVAAKNTYNAVVLSSIITVTDTETNAKLSASMIERFDAHEKDLVELKAFIKLNLPKQYEEIFSNAAIDGYAGYIDGTKQVDFYKYLKTTLENVEGADYFITKIEEENFLRKQRTFDNGVIPHQLHLEELEAILHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKIRYIDDQGKTNYFSGQEKQQIFNDLFKQKRKVKKKDLELFLRNINHVESPTIEGLEDSFNASYATYHDLMKVGIKQEILDNPLNTEMLEDIVKILTVFEDKRMIKEQLQQFSDVLDGTVLKKLERRHYTGWGRLSAKLLVGIRDKQSHLTILDYLMDDGLNRNLMQLINDSNLSFKSIIEKEQVSTADKDLQSIVADLAGSPAIKKGILQSLKVVEELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGDNVPPLEIVQKRKIFWEKLYQGNLMSKRKFDYLTKAERGGLTEADKARFIHRQLVETRQITKNVANILHQRFNYKTDDNEDTMEPVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLNYRQMNIVKKTEIQKGEFSNQNPKPRGDSSKLIPKKTNLNPIKYGGFEGSNMAYAIIIEHEKRKKKVTIEKKLIQINIMERKAFEKDEKVFLEGKGYHQPKVLTKLPKYALYECENGRRRMLGSANEVHKGNQMLLPNHLMTLLYHAEKREAIDGESLAYIEAHKAVFGELLAHISEFARKYTLANDKLDEINMLYERNKDGDVKSIAESFVSLKKFNAFGVHKDFNFFGTTIKRKRDRKLKELLNSTIIYQSITGLYESRKRLDS

SEQ ID NO: 344 - protein, 1327 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEKVEENIEVANILAGKFTRREKFERILQLYPGEKSTGMFAQFISLIVGSKGNFQKVFDLIEKTDIECAKDSYEEDLETLLAIIGDEYAELFVAAKNTYNAVVLSSIITVNDTETNAKLSASMIERFDAHEKDLVELKAFIKLNLPKQYEEIFSNAAIDGYAGYIDGTKQVDFYKYLKTILENIEGSDYFIAKIEEENFLRKQRTFDNGAIPHQLHLEELEAIIHQQAKYYTFLKEDYDKIKSLVTFRIPYFVGPLANGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINQIESPTIEGLEDSFNASYATYHDLLKVGMKQEILDNPLNTEMLEDIVKILTVFEDKRMIKEQLQQFSDVLDGVVLKKLERRHYTGWGRLSAKLLVGIRDKQSHLTILEYLMDDGLNRNLMQLINDSNLSFKSIIEKEQVSTTDKDLQSIVAELAGSPAIKKGILQSLKIVDELVSIMGYPPQTIVVEMARENQTTGKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKRIVIEKKLIQINIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIKAIAQSFVDLMAFNAMGAPASFKFFEATIDRKRYTNLKELLSSTIIYQSITGLYESRKRLDD

SEQ ID NO: 345 - protein, 1327 aa, Listeria monocytogenes
MKKPYTIGLDIGTNSVGWAVLTDQYDLVKRKMKISGDSEKKQIKKNFWGVRLFEKGETAAKRRMSRTARRRIERRRNRISYLQEIFAIQMNEVDDNFFNRLKESFYAESDKKYNRHPFFGTVEEEVAYYKDFPTIYHLRKELIDSQKKADLRLVYLALAHIIKYRGHFLIEGALDTKNTSIDEMFKQFLQIYNQVFANDIEKTEKNQEVAQILAEKFTRKDKLDKILSLYPGEKTTGVFAQFVNIIVGSTGKFKKHFNLHEKKDINCAEDTYDTDLESLLAIIGDEFAEVFVAAKNAYNAVVLSNIITVTDSTTRAKLSASLIERFENHKEDLKKMKRFVRTYLPEKYDEIFDDTEKHGYAGYISGTKQADFYKYMKATLEKIEGADYFIAKIEEENFLRKQRTFDNGVIPHQLHLEELEAILHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINQIESPTIEGLEDSFNASYATYHDLLKVGMKQEILDNPLNTEMLEDIVKILTVFEDKRMIKEQLQQFSDVLDGTVLKKLERRHYTGWGRLSAKLLVGIRDKQSHLTILDYLMDDGLNRNLMQLINDSNLSFKSIIEKEQVSTADKDLQSIVADLAGSPAIKKGILQSLKIVDELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSVDNLVLTSSAGNREKGDNVPPLEIVQKRKIFWEKLYQGNLMSKRKFDYLTKAERGGLTEADKARFIHRQLVETRQITKNVANILHQRFNYKTDGNKDTMETVRIVTLKSALVSQFRKQFQFYKVREVNDYHHAHDAYLNGVVANTLLKVYPQLEPEFVYGEYHQFDWFKANKATAKKQFYTNIMLFFAQKDRIIDENGEILWDKRYLETVKKVLGYRQMNIVKKTEIQKGEFSNVTPNPKGKSNKLIPRKKDWDPIKYGGFDGSKMAYAIIIEYEKQKRKVRIEKKLIQINIMEREAFEKDEKTFLEEKGYHQPKVLIKVPKYTLYECENGRRRMLGSANEAHKGNQMLLPNHLMALLYHAEKYEAIDGESLAYIEVHRALFDELLAYISEFARKYTLSNDRLDEINMLYERNKDGDVKSIAESFVSLKKFNAFGVHQDFSFFGTKIERKRDRKLNELLNSTIIYQSITGLYESRKRLDN

SEQ ID NO: 346 - protein, 1327 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEKVEENIEVANILARKFTRREKFERILQLYPGEKSTGMFAQFISLIVGSKGNFQKVFDLIEKTDIECAKDSYEEDLETLLAIIGDEYAELFVAAKNTYNAVVLSSIITVTDTETNAKLSASMIERFDAHEKDLVELKAFIKLNLPKQYEEIFSNAAIDGYAGYIDGTKQVDFYKYLKTILENIEGADYFIAKIEEENFLRKQRTFDNGAIPHQLHLEELEAIIHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKIRYIDDQGKTNYFSGQEKQQIFNDLFKQKRKVKKKDLELFLRNINHVESPTIEGLEDSFNASYATYHDLMKVGIKQEILDNPLNTEMLEDIVKILTVFEDKRMIKEQLQQFSDVLDGTVLKKLERRHYTGWGRLSAKLLVGIRDKQSHLTILDYLMDDGLNRNLMQLINDSNLSFKSIIEKEQVSTADKDLQSIVADLAGSPAIKKGILQSLKVVEELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGDNVPPLEIVQKRKIFWEKLYQGNLMSKRKFDYLTKAERGGLTEADKARFIHRQLVETRQITKNVANILHQRFNYKTDDNEDTMEPVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLNYRQMNIVKKTEIQKGEFSNQNPKPRGDSSKLIPKKTNLNPIKYGGFEGSNMAYAIIIEHEKRKKKVTIEKKLIQINIMERKAFEKDEKVFLEGKGYHQPKVLTKLPKYALYECENGRRRMLGSANEVHKGNQMLLPNHLMTLLYHAEKREAIDGESLAYIEAHKAVFGELLAHISEFARKYTLANDKLDEINMLYERNKDGDVKSIAESFVSLKKFNAFGVHKDFNFFGTTIKRKRDRKLKELLNSTIIYQSITGLYESRKRLDS

SEQ ID NO: 347 - protein, 1327 aa, Listeria monocytogenes; identical to SEQ ID NO: 342

SEQ ID NO: 348 - protein, 1327 aa, Listeria monocytogenes; identical to SEQ ID NO: 346

SEQ ID NO: 349 - protein, 781 aa, Listeria monocytogenes
  misc_feature (721)..(721): Xaa can be any naturally occurring amino acid
IFNDLFKQKRKVKKKDLELFLRNINQIESPTIEGLEDSFNASYATYHDLLKVGMKQEILDNPLNTEMLEDIVKILTVFEDKRMIKEQLQQFSDVLDGVVLKKLERRHYTGWGRLSAKLLVGIRDKQSHLTILEYLMDDGLNRNLMQLINDSNLSFKSIIEKEQVSTTDKDLQSIVADLAGSPAIKKGILQSLKIVDELVSIMGYPPQTIVVEMARENQTTVKGKNNSRPRYKSLEKAIKEFGSQILKEHPTDNQELKNNRLYLYYLQNGKDIYTGQELDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNNETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKIVIEKKLIQINIMERKMFEKDEEAFLEEKGYRHPKVLTKLPKYTLYECEKGRRRMLASANEAQKGNQLVLSNHLVSLLYHAKNCEASDGKSLKYTEAHRETFSELLAQVSEFATRYTLADANLSKINNLFEQNKEGDIKXIAQSFVDLMVFNAMGAPASFKFFEATIDRKRYTNLKELLSSTIIYQSITGLYESRKRLDD

SEQ ID NO: 350 - protein, 1327 aa, Listeria seeligeri
MKKPYTIGLDIGTNSVGWAALTDQYDLVKRKMKVAGNSEKKQIKKNLWGVRLVDEGKTAAHRRVNRTTRRRIERRRNRISYLQEIFTAEMFEVDANFFYRLEDSFYIESEKRQSRHPFFATIEEEVAYHENYRTIYHLREKLVNSSDKADLRLVYLALAHIIKYRGNFLIEGKLDTKNTSVDEVFKQFIKTYNQVFASDIERIEENNEVAKIFSEKLTKREKLDKILNLYPNEKSTDLFAQFISLIIGSKGNFKKFFNLTEKTDIECAKDSYEEDLEVLLARVGDEYAEIFVAAKNAYNAVVLSSIITVSNTETKAKLSASMIERFDKHDKDLKRMKAFFKVRLPENFNEVFNDVEKDGYAGYIEGTKQEAFYKYMKKMLEHVEGADYFINQIEEENFLRKQRTFDNGAIPHQLHLEELEAILHQQAKYYPFLKVDYEKIKSLVTFRIPYFVGPLANGQSEFSWLTRKADGEIRPWNIEEKVDFGKSAIDFIEKMTNKDTYLPKENVLPKHSMCYQKYMVYNELTKIRYTDDQGKTHYFSGQEKQQIFNDLFKQKRKVKKKDLELFLYNMNHVESPTVEGVEDAFNSSFTTYHDLQKVGVPQEILDDPLNTEMLEEIIKILTVFEDKRMINERLQEFSNVLDEAVLKKLERRHYTGWGRLSAKLLIGIRDKESHLTILDYLMDDKHNRNLMQLINDSNLSFKSIIEKEQVSTADKDIQSIVADLAGSPAIKKGILQSLKIVDELVGIMGYPPQTIVVEMARENQTTGKGKNNSKPRFTSLEKAIKELGSQILKEHPTDNQGLKNDRLYLYYLQNGKDMYTGQELDIHNLSNYDIDHVVPQSFITDNSIDNRVLASSAANREKGDNVPSLEVVRKRKVYWEKLYQAKLMSKRKFDYLTKAERGGLTEADKARFIHRQLVETRQITKNVANILHQRFNCKKDESGNVIEQVRIVTLKAALVSQFRKQFQLYKVREVNDYHHAHDAYLNCVVANTLLKVYPQLEPEFVYGDYHQFDWFKANKATAKKQFYTNIMLFFAKKDRIIDENGEILWDKKYLDTIKKVLNYRQMNIVKKTEIQKGEFSNATANPKGNSSKLIPRKADWDPIKYGGFDGSNMAYAIVIEHEKRKKKTVIKKELIQINIMERTAFEKDQKEFLEGKGYRNPKVITKIPKYTLYECENGRRRMLGSANEAQKGNQMVLPNHLMTLLYHAKNCEASDGKSLAYIESHREMFAELLDSISEFASRYTLADANLEKINTIFEQNKSGDVKVIAQSFVNLLEFNAMGAPASFKYFETNIERKRYNNLKELLNATIIYQSITGLYEARKRLDD

SEQ ID NO: 351 - protein, 1359 aa, Artificial Sequence; identical to SEQ ID NO: 325
  Synthetic Polypeptide

SEQ ID NO: 352 - protein, 1290 aa, Roseburia hominis
IVDYCIGLDLGTGSVGWAVVDMNHRLMKRNGKHLWGSRLFSNAETAATRRSSRSIRRRYNKRRERIRLLRAILQDMVLEKDPTFFIRLEHTSFLDEEDKAKYLGDNYNLFIDEDFNDYTYYHKYPTIYHLRKALCESTEKADPRLIYLALHHIVKYRGNFLYEGQKFNMDASNIEDKLSDVFTQFADFNNIPYEDDKKNLEILEILKKPLSKKAKVDEVMALISPEKEFKSAYKELVTGIAGNKMNVTKMILCESIKQGDSEIKLKFSDSNYDDQFSEVENDLGEYVEFIDSLHNIYSWVELQTIMGATHTDNASISEAMVSRYNKHHEDLQLLKKCIKDNVPKKYFDMFRNDSEKVKGYYNYINRKAPVDEFYKFVKKCIEKVDTPEAKQILHDIELENFLLKQNSRTNGSVPYQMQLDEMIKIIDNQAKYYPVLKEKREQLLSILTFRIPYYFGPLETSEHAWIKRLEGKENQRILPWNYQDTVDVDATAEGFIKRMRSYCTYFPDEEVLPKNSLIVSKYEVYNELNKIRVDDKLLEVDVKNDIYNELFMKNKTVTEKKLKNWLVNNQCCRKDAEIKGFQKENQFSTSLTPWIDFTNIFGKIDQSNFDLIEKIIYDLTVFEDKKIMKRRLKKKYALPDDKIKQILKLKYKDWSRLSKKLLDGIVADSVTVLDVLESRLNLMEIINDKELGYAQMIEEASSCPKDGKFTYEEVAKLAGSPALKRGIWQSLQIVEEITKVMKCRPKYIYIEFERSEEKERTESKIKKLENVYKDEQTSVLEELKGFDNTKKISSDSLFLYFTQLGKCMYSGKKLDIDSLDKYQIDHIVPQSLVKDDSFDNRVLVLPSENQRKLDDLVVPFDIRDKMYRFWKLLFDHELISPKKFYSLIKTEYTERDEERFINRQLVETRQITKNVTQIIEDHYSTTKVAAIRANLSHEFRVKNHIYKNRDINDYHHAHDAYIVALIGGFMRDRYPNMHDSKAVYSEYMKMFRNKNDQKGFVINSMNYPYEVDGKLIWNPDLINEIKKCFYYKDCYCTTKLDQKSGQMFNTVLPNDAHSAKGAVIPVNKNRKDVNKYGGFSGLQYVIAAIEGTKKKGKKLVKVRKLSGIPLYLKQADIKEQIEYVEKEEKLSDVKIIKNNIPLNQLIEIDGRQYLLTSECVNAMQLVLNEEQCKLIADIYNAIYKQDFDGLDNMLMIQLYLQLIDKLKTLYPIYMGIVEKFEKFVSISKEEKANVIQMLIIMHKGPQNGNIIYDDFNVGKRIGRLNGRTFYLNIEFISQSPTGIYTKKYKL

SEQ ID NO: 353 - protein, 1292 aa, Sharpea azabuensis
KDIRYSIGLDIGTNSVGWAVMDEHYELLKKGNHHMWGSRLFDAAEPAATRRASRSIRRRYNKRRERIRLLRDLLGDMVMEVDPTFFIRLLNVSFLDEEDKQKNLGDNYNLFIEKDFNDKTYYDKYPTIYHLRKELCENKEKADPRLIYLALHHIVKYRGNFLYEGQSFTMDNSDIEERLNSAIEKFMSINEFDNRIVSDINSMIAVLSKIYQRSKKADDLLKIMNPTKEEKAAYKEFTKALVGLKFNISKMILAQEVKKGDTDIVLEFSNANYDSTIDELQSELGEYIEFIEMLHNIYSWVELQAILGATHTDNPSISAAMVERYEEHKKDLRVLKKVIREELPDKYNEVFRKDNRKLHNYLGYIKYDTPVEEFYKYIKGLLAKVDTDEAREILERIDLEKFMLKQNSRTNGSIPYQMQKDEMIQIIDNQSVYYPQLKENRDKLISILEFRIPYYFGPLAHSEFAWIKKFEDKQKERILPWNYDQIVDIDATAEGFIERMKNTGTYFPDEPVMAKNSLTVSKFEVLNELNKIRINGKLIAVETKKELLSDLFMKNKTITDKKLKDWLVTHQYYDINEELKIEGYQKDLQFSTSLAPWIDFTKIFGEINASNYQLIEKIIYDISIFEDKKILKRRLKKVYQLDDLLVDKILKLNYTGWSRLSEKLLTGMTADKATVLFVLESNKNLMEIINDEKLGYKQIIEESNMQDIEGPFKYDEVKKLAGSPAIKRGIWQALLVVREITKFMKHEPSHIYIEFAREEQKVRKESKIAKLQKIYENLQTQVYESLKKEDAKKRMETDALYLYYLQMGKSMYSGKPLDIDKLSTYQIDHILPQSLIKDDSFDNRVLVLPEENQWKLDSETVPFEIRNKMIGFWQMLHENGLMSNKKFFSLIRTDFSDKDKERFINRQLVETRQIIKNVAVIINDHYTNTNIVTVRAELSHQFRERYKIYKNRDINDFHHAHDAYIACIVGQFMHQNFEHLDAKIIYGQYKKNYKKNYGFILNSMNHLQSDIDTGEVMWDPAKIGKIKSCFYYKDVYVTKKLEQNSGTLFNTVLPNDAHSEKGATVPLNKYRADVHKYGGFGNVQSIIVAIEGKKKKGKKLIDVRKLTSIPLHLKNAPVEEQLSYIASPEHEDLIDVRIVKEILKNQLIEIDGGLYYVTSEYVTARQLSLNEQSCKLISEIYAAMLKKRYEYLDEEEIFDLYLQLLQKMDTLYPAYKGIAKRFFDFKNIDVVEKCDVIQILIIMHAGPMNGNIMYDDFKFTNRIGRFTHKNIDLKTTFISTSVTGLFSKKYKL

SEQ ID NO: 354 - protein, 1359 aa, Artificial Sequence; identical to SEQ ID NO: 325
  Synthetic Polypeptide

SEQ ID NO: 355 - protein, 1359 aa, Artificial Sequence
  Synthetic Polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 356 - protein, 1359 aa, Artificial Sequence; identical to SEQ ID NO: 108
  Synthetic Polypeptide

SEQ ID NO: 357 - protein, 1359 aa, Artificial Sequence; identical to SEQ ID NO: 355
  Synthetic Polypeptide

SEQ ID NO: 358 - DNA, 23 bp, Artificial Sequence
  Synthetic Polynucleotide
agaaaaacaattttagtatttgg

SEQ ID NO: 359 - DNA, 23 bp, Artificial Sequence
  Synthetic Polynucleotide
gcagaaatagactaattgcatgg

SEQ ID NO: 360 - DNA, 20 bp, Artificial Sequence
  Synthetic Polynucleotide
gtcacccctgcgctgacagc

SEQ ID NO: 361 - DNA, 96 bp, Artificial Sequence
  Synthetic Polynucleotide
cttcggcttcccctggagagagcgagattctccgcgctgtagaagtcatcattgttgtgcacgacgacatcattccgtggcgttatccagctaagc

SEQ ID NO: 362 - protein, 34 aa, Artificial Sequence
  Synthetic Polypeptide
TSASPGESEILRAVEVIIVVHDDIIPWRWRYPAK

SEQ ID NO: 363 - DNA, 23 bp, Artificial Sequence
  Synthetic Polynucleotide
gtaaacaaagcatagactgaggg

SEQ ID NO: 364 - DNA, 23 bp, Artificial Sequence
  Synthetic Polynucleotide
gaagaccaaggatagactgctgg

SEQ ID NO: 365 - DNA, 23 bp, Artificial Sequence
  Synthetic Polynucleotide
gttttgtttagtaactgacgtcc

SEQ ID NO: 366 - DNA, 23 bp, Artificial Sequence
  Synthetic Polynucleotide
cttgtatttcttatcttactacc

SEQ ID NO: 367 - DNA, 23 bp, Artificial Sequence
  Synthetic Polynucleotide
cttgtgtttcgtatctgacgccc

SEQ ID NO: 368 - DNA, 23 bp, Artificial Sequence
  Synthetic Polynucleotide
gaatactaagcatagactccagg

SEQ ID NO: 369 - DNA, 23 bp, Artificial Sequence
  Synthetic Polynucleotide
gaaaacaaatcattgactgcagg

SEQ ID NO: 370 - DNA, 23 bp, Artificial Sequence
  Synthetic Polynucleotide
gaacataaagaatagaatgatgg

SEQ ID NO: 371 - protein, 183 aa, Salmonella typhimurium
MPPAFITGVTSLSDVELDHEYWMRHALTLAKRAWDEREVPVGAVLVHNHRVIGEGWNRPIGRHDPTAHAEIMALRQGGLVLQNYRLLDTTLYVTLEPCVMCAGAMVHSRIGRVVFGARDAKTGAAGSLIDVLHHPGMNHRVEIIEGVLRDECATLLSDFFRMRRQEIKALKKADRAEGAGPAV

SEQ ID NO: 372 - protein, 164 aa, Shewanella putrefaciens
MDEYWMQVAMQMAEKAEAAGEVPVGAVLVKDGQQIATGYNLSISQHDPTAHAEILCLRSAGKKLENYRLLDATLYITLEPCAMCAGAMVHSRIARVVYGARDEKTGAAGTVVNLLQHPAFNHQVEVTSGVLAEACSAQLSRFFKRRRDEKKALKLAQRAQQGIE

SEQ ID NO: 373 - protein, 173 aa, Haemophilus influenzae
MDAAKVRSEFDEKMMRYALELADKAEALGEIPVGAVLVDDARNIIGEGWNLSIVQSDPTAHAEIIALRNGAKNIQNYRLLNSTLYVTLEPCTMCAGAILHSRIKRLVFGASDYKTGAIGSRFHFFDDYKMNHTLEITSGVLAEECSQKLSTFFQKRREEKKIEKALLKSLSDK

SEQ ID NO: 374 - protein, 161 aa, Caulobacter crescentus
MRTDESEDQDHRMMRLALDAARAAAEAGETPVGAVILDPSTGEVIATAGNGPIAAHDPTAHAEIAAMRAAAAKLGNYRLTDLTLVVTLEPCAMCAGAISHARIGRVVFGADDPKGGAVVHGPKFFAQPTCHWRPEVTGGVLADESADLLRGFFRARRKAKI

SEQ ID NO: 375 - protein, 179 aa, Geobacter sulfurreducens
MSSLKKTPIRDDAYWMGKAIREAAKAAARDEVPIGAVIVRDGAVIGRGHNLREGSNDPSAHAEMIAIRQAARRSANWRLTGATLYVTLEPCLMCMGAIILARLERVVFGCYDPKGGAAGSLYDLSADPRLNHQVRLSPGVCQEECGTMLSDFFRDLRRRKKAKATPALFIDERKVPPEP

SEQ ID NO: 376 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 377 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 378 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 379 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 380 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 381 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 382 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 383 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 384 - protein, 24 aa, Artificial Sequence
  Synthetic Polypeptide
SGGSSGSETPGTSESATPESSGGS

SEQ ID NO: 385 - protein, 32 aa, Artificial Sequence
  Synthetic Polypeptide
SGGSSGGSSGSETPGTSESATPESSGGSSGGS

SEQ ID NO: 386 - protein, 104 aa, Artificial Sequence
  Synthetic Polypeptide
GGSGGSPGSPAGSPTSTEEGTSESATPESGPGTSTEPSEGSAPGSPAGSPTSTEEGTSTEPSEGSAPGTSTEPSEGSAPGTSESATPESGPGSEPATSGGSGGS

SEQ ID NO: 387 - protein, 1782 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSKGHLTRLGLEFFDQPAVPLARAFLGQVLVRRLPNGTELRGRIVETQAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQAGGSPKKKRKV

SEQ ID NO: 388 - protein, 1785 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSDLASLRAQQIELASSVIREDRLDKDPPDLIAGAAVGFEQGGEVTRAAMVLLKYPSLELVEYKVARIATTMPYIPGFLSFREYPALLAAWEMLSQKPDLVFVDGHGISHPRRLGVASHFGLLVDVPTIGVAKKRLCGKFEPLSSEPGALAPLMDKGEQLAWVWRSKARCNPLFIATGHRVSVDSALAWVQRCMKGYRLPEPTRWADAVASERPAFVRYTANQPGGSPKKKRKV

SEQ ID NO: 389 - RNA, 82 nt, Artificial Sequence
  Synthetic Polynucleotide
guuuuagagcuagaaauagcaaguuaaaauaaaggcuaguccguuaucaacuugaaaaaguggcaccgagucggugcuuuuu

SEQ ID NO: 390 - DNA, 20 bp, Artificial Sequence
  Synthetic Polynucleotide
gaacacaaagcatagactgc

SEQ ID NO: 391 - DNA, 20 bp, Artificial Sequence
  Synthetic Polynucleotide
ggaacacaaagcatagactg

SEQ ID NO: 392 - DNA, 20 bp, Artificial Sequence
  Synthetic Polynucleotide
aacacaaagcatagactgcg

SEQ ID NO: 393 - DNA, 20 bp, Artificial Sequence
  Synthetic Polynucleotide
acaaagcatagactgcgggg

SEQ ID NO: 394 - DNA, 20 bp, Artificial Sequence
  Synthetic Polynucleotide
caaagcatagactgcggggc

SEQ ID NO: 395 - DNA, 20 bp, Artificial Sequence
  Synthetic Polynucleotide
gtggtaattttccagcccgc

SEQ ID NO: 396 - DNA, 20 bp, Artificial Sequence
  Synthetic Polynucleotide
cctttacagggccagcgggc

SEQ ID NO: 397 - DNA, 20 bp, Artificial Sequence
  Synthetic Polynucleotide
ctgtcacagttagctcagcc

SEQ ID NO: 398 - DNA, 20 bp, Artificial Sequence
  Synthetic Polynucleotide
gtgttccagtttcctttaca

SEQ ID NO: 399 - DNA, 20 bp, Artificial Sequence
  Synthetic Polynucleotide
gaacacaatgcatagattgc

SEQ ID NO: 400 - DNA, 20 bp, Artificial Sequence
  Synthetic Polynucleotide
gaaaaaaaagcagagactgc

SEQ ID NO: 401 - DNA, 20 bp, Artificial Sequence
  Synthetic Polynucleotide
gaatactaagcatagactcc

SEQ ID NO: 402 - DNA, 20 bp, Artificial Sequence
  Synthetic Polynucleotide
gtaaacaaagcatagactga

SEQ ID NO: 403 - DNA, 20 bp, Artificial Sequence
  Synthetic Polynucleotide
ggacacaaagcttagactcc

SEQ ID NO: 404 - DNA, 20 bp, Artificial Sequence
  Synthetic Polynucleotide
caatacaaaggatagactgc

SEQ ID NO: 405 - DNA, 20 bp, Artificial Sequence
  Synthetic Polynucleotide
gaagaccaaggatagactgc

SEQ ID NO: 406 - DNA, 20 bp, Artificial Sequence
  Synthetic Polynucleotide
gaaaacaaatcattgactgc

SEQ ID NO: 407 - DNA, 20 bp, Artificial Sequence
  Synthetic Polynucleotide
gatcacaaagcatggactga

SEQ ID NO: 408 - DNA, 20 bp, Artificial Sequence
  Synthetic Polynucleotide
gaaaacaaaacatagagtgc

SEQ ID NO: 409 - DNA, 20 bp, Artificial Sequence
  Synthetic Polynucleotide
gaacataaagaatagaatga

SEQ ID NO: 410 - DNA, 20 bp, Artificial Sequence
  Synthetic Polynucleotide
gagtccgagcagaagaagaa

SEQ ID NO: 411 - DNA, 20 bp, Artificial Sequence
  Synthetic Polynucleotide
ggaatcccttctgcagcacc

SEQ ID NO: 412 - DNA, 20 bp, Artificial Sequence
  Synthetic Polynucleotide
gaacacaaagcatagactgc

SEQ ID NO: 413 - DNA, 20 bp, Artificial Sequence
  Synthetic Polynucleotide
ggcccagactgagcacgtga

SEQ ID NO: 414 - DNA, 20 bp, Artificial Sequence
  Synthetic Polynucleotide
ggcactgcggctggaggtcc

SEQ ID NO: 415 - DNA, 20 bp, Artificial Sequence
  Synthetic Polynucleotide
gtcatcttagtcattacctg

SEQ ID NO: 416 - protein, 887 aa, Natronobacterium gregoryi
MTVIDLDSTTTADELTSGHTYDISVTLTGVYDNTDEQHPRMSLAFEQDNGERRYITLWKNTTPKDVFTYDYATGSTYIFTNIDYEVKDGYENLTATYQTTVENATAQEVGTTDEDETFAGGEPLDHHLDDALNETPDDAETESDSGHVMTSFASRDQLPEWTLHTYTLTATDGAKTDTEYARRTLAYTVRQELYTDHDAAPVATDGLMLLTPEPLGETPLDLDCGVRVEADETRTLDYTTAKDRLLARELVEEGLKRSLWDDYLVRGIDEVLSKEPVLTCDEFDLHERYDLSVEVGHSGRAYLHINFRHRFVPKLTLADIDDDNIYPGLRVKTTYRPRRGHIVWGLRDECATDSLNTLGNQSVVAYHRNNQTPINTDLLDAIEAADRRVVETRRQGHGDDAVSFPQELLAVEPNTHQIKQFASDGFHQQARSKTRLSASRCSEKAQAFAERLDPVRLNGSTVEFSSEFFTGNNEQQLRLLYENGESVLTFRDGARGAHPDETFSKGIVNPPESFEVAVVLPEQQADTCKAQWDTMADLLNQAGAPPTRSETVQYDAFSSPESISLNVAGAIDPSEVDAAFVVLPPDQEGFADLASPTETYDELKKALANMGIYSQMAYFDRFRDAKIFYTRNVALGLLAAAGGVAFTTEHAMPGDADMFIGIDVSRSYPEDGASGQINIAATATAVYKDGTILGHSSTRPQLGEKLQSTDVRDIMKNAILGYQQVTGESPTHIVIHRDGFMNEDLDPATEFLNEQGVEYDIVEIRKQPQTRLLAVSDVQYDTPVKSIAAINQNEPRATVATFGAPEYLATRDGGGLPRPIQIERVAGETDIETLTRQVYLLSQSHIQVHNSTARLPITTAYADQASTHATKGYLVQTGAFESNVGFL

SEQ ID NO: 417 - protein, 345 aa, Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYEFGRSPGMVERTRRVKLEVEPHYLIIAAAGWVLTRLGKAKVSEGDYVGVNVFTPTRGILYSLIQNVNGIVPGIKPETAFGLWIARKVVSSVTNPNVSVVRIYTISDAVGQNPTTINGGFSIDLTKLLEKRYLLSERLEAIARNALSISSNMRERYIVLANYIYEYLTGSKRLEDLLYFANRDLIMNLNSDDGKVRDLKLISAYVNGELIRGEG

SEQ ID NO: 418 - protein, 345 aa, Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYKFGRSPGMVERTRRVKLEVEPHYLIMAAAGWVLTRLGKAKVSEGDYVGVNVFTPTRGILYSLIQNVNGIVPGIKPETAFGLWIARKVVSSVTNPNVSVVSIYTISDAVGQNPTTINGGFSIDLTKLLEKRDLLSERLEAIARNALSISSNMRERYIVLANYIYEYLTGSKRLEDLLYFANRDLIMNLNSDDGKVRDLKLISAYVNGELIRGEG

SEQ ID NO: 419 - protein, 1210 aa, Parcubacteria group bacterium
MSKRHPRISGVKGYRLHAQRLEYTGKSGAMRTIKYPLYSSPSGGRTVPREIVSAINDDYVGLYGLSNFDDLYNAEKRNEEKVYSVLDFWYDCVQYGAVFSYTAPGLLKNVAEVRGGSYELTKTLKGSHLYDELQIDKVIKFLNKKEISRANGSLDKLKKDIIDCFKAEYRERHKDQCNKLADDIKNAKKDAGASLGERQKKLFRDFFGISEQSENDKPSFTNPLNLTCCLLPFDTVNNNRNRGEVLFNKLKEYAQKLDKNEGSLEMWEYIGIGNSGTAFSNFLGEGFLGRLRENKITELKKAMMDITDAWRGQEQEEELEKRLRILAALTIKLREPKFDNHWGGYRSDINGKLSSWLQNYINQTVKIKEDLKGHKKDLKKAKEMINRFGESDTKEEAVVSSLLESIEKIVPDDSADDEKPDIPAIAIYRRFLSDGRLTLNRFVQREDVQEALIKERLEAEKKKKPKKRKKKSDAEDEKETIDFKELFPHLAKPLKLVPNFYGDSKRELYKKYKNAAIYTDALWKAVEKIYKSAFSSSLKNSFFDTDFDKDFFIKRLQKIFSVYRRFNTDKWKPIVKNSFAPYCDIVSLAENEVLYKPKQSRSRKSAAIDKNRVRLPSTENIAKAGIALARELSVAGFDWKDLLKKEEHEEYIDLIELHKTALALLLAVTETQLDISALDFVENGTVKDFMKTRDGNLVLEGRFLEMFSQSIVFSELRGLAGLMSRKEFITRSAIQTMNGKQAELLYIPHEFQSAKITTPKEMSRAFLDLAPAEFATSLEPESLSEKSLLKLKQMRYYPHYFGYELTRTGQGIDGGVAENALRLEKSPVKKREIKCKQYKTLGRGQNKIVLYVRSSYYQTQFLEWFLHRPKNVQTDVAVSGSFLIDEKKVKTRWNYDALTVALEPVSGSERVFVSQPFTIFPEKSAEEEGQRYLGIDIGEYGIAYTALEITGDSAKILDQNFISDPQLKTLREEVKGLKLDQRRGTFAMPSTKIARIRESLVHSLRNRIHHLALKHKAKIVYELEVSRFEEGKQKIKKVYATLKKADVYSEIDADKNLQTTVWGKLAVASEISASYTSQFCGACKKLWRAEMQVDETITTQELIGTVRVIKGGTLIDAIKDFMRPPIFDENDTPFPKYRDFCDKHHISKKMRGNSCLFICPFCRANADADIQASQTIALLRYVKEEKKVEDYFERFRKLKNIKVLGQMKKI

SEQ ID NO: 420 - protein, 166 aa, Artificial Sequence
  Synthetic Polypeptide
SEVEFSHEYWMRHALTLAKRAWDAGEVPVGAVLVHNNRVIGEGWNRPIGRHDPTAHAEIMALRQGGLVMQNYRLIDATLYVTFEPCVMCAGAMIHSRIGRVVFGVNNAKTGAAGSLMDVLHYPGMNHRVEITEGILADECNELLSYFFRMRRQVFKAQKKAQSSTD

SEQ ID NO: 421 - protein, 166 aa, Artificial Sequence; identical to SEQ ID NO: 73
  Synthetic Polypeptide

SEQ ID NO: 422 - protein, 166 aa, Artificial Sequence
  Synthetic Polypeptide
SEVEFSHEYWMRHALTLAKRAWDEREVPVGAVLVHTNRVIGEGWNRTIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTD

SEQ ID NO: 423 - protein, 166 aa, Artificial Sequence
  Synthetic Polypeptide
SEVEFSHEYWMRHALTLAKRAWDEREVPVGAVLVHSNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTD

SEQ ID NO: 424 - protein, 166 aa, Artificial Sequence
  Synthetic Polypeptide
SEVEFSHEYWMRHALTLAKRAWDEREVPVGAVLVLNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTD

SEQ ID NO: 425 - protein, 166 aa, Artificial Sequence
  Synthetic Polypeptide
SEVEFSHEYWMRHALTLAKRAWDEREVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLRYFFRMRRQVFKAQKKAQSSTD

SEQ ID NO: 426 - protein, 166 aa, Artificial Sequence
  Synthetic Polypeptide
SEVEFSHEYWMRHALTLAKRAWDEREVPVGAVLVLNNRVIGEGWNRLIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTD

SEQ ID NO: 427 - protein, 166 aa, Artificial Sequence
  Synthetic Polypeptide
SEVEFSHEYWMRHALTLAKRAWDEREVPVGAVLVLNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFNAQKKAQSSTD

SEQ ID NO: 428 - protein, 166 aa, Artificial Sequence
  Synthetic Polypeptide
SEVEFSHEYWMRHALTLAKRAWDEREVPVGAVLVLNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFKAQKKAQSSTD

SEQ ID NO: 429 - protein, 166 aa, Artificial Sequence; identical to SEQ ID NO: 425
  Synthetic Polypeptide

SEQ ID NO: 430 - protein, 166 aa, Artificial Sequence
  Synthetic Polypeptide
SEVEFSHEYWMRHALTLAKRAWDEREVPVGAVLVHSNRVIGEGWNRPIGHHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTD

SEQ ID NO: 431 - protein, 166 aa, Artificial Sequence
  Synthetic Polypeptide
SEVEFSHEYWMRHALTLAKRAWDEREVPVGAVLVHNNRVIGEGWNRPIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFNAQKKAQSSTD

SEQ ID NO: 432 - protein, 166 aa, Artificial Sequence
  Synthetic Polypeptide
SEVEFSHEYWMRHALTLAKRAWDEREVPVGAVLVHNNRVIGEGWNRPIGHHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFNAQKKAQSSTD

SEQ ID NO: 433 - protein, 159 aa, Artificial Sequence
  Synthetic Polypeptide
GSHMTNDIYFMTLAIEEAKKAAQLGEVPIGAIITKDDEVIARAHNLRETLQQPTAHAEHIAIERAAKVLGSWRLEGCTLYVTLEPCVMCAGTIVMSRIPRVVYGADNPKGGCSGSLMNLLQQSNFNHRAIVDKGVLKEACSTLLTTFFKNLRANKKSTN

SEQ ID NO: 434 - protein, 159 aa, Artificial Sequence
  Synthetic Polypeptide
GSHMTNDIYFMTLAIEEAKKAAQLGEVPIGAIITKDDEVIARAHNLRETLQQPTAHAEHIAIERAAKVLGSWRLEGCTLYVTLEPCVMCAGTIVMSRIPRVVYGAANPKGGCSGSLMNLLQQSNFNHRAIVDKGVLKEACSTLLTTFFKNLRANKKSTN

SEQ ID NO: 435 - protein, 159 aa, Artificial Sequence
  Synthetic Polypeptide
GSHMTNDIYFMTLAIEEAKKAAQLPEVPIGAIITKDDEVIARAHNLRETLQQPTAHAEHIAIERAAKVLGSWRLEGCTLYVTLEPCVMCAGTIVMSRIPRVVYGAANPKGGCSGSLMNLLQQSNFNHRAIVDKGVLKEACSTLLTTFFKNLRANKKSTN

SEQ ID NO: 436 - protein, 159 aa, Artificial Sequence
  Synthetic Polypeptide
GSHMTNDIYFMTLAIEEAKKAAQLPEVPIGAIITKDDEVIARAHNLRETLQQPTAHAEHIAIERAAKVLGSWRLEGCTLYVTLEPCVMCAGTIVMSRIPRVVYGAANPKGGCSGSLMNLLQQSNFNHRAIVDKGVLKEACATLLTTFFKNLRANKKSTN

SEQ ID NO: 437 - protein, 159 aa, Artificial Sequence
  Synthetic Polypeptide
GSHMTNDIYFMTLAIEEAKKAAQLGEVPIGAIITKDDEVIARAHNLRETLQQPTAHAEHIAIERAAKVLGSWRLEGCTLYVTLEPCVMCAGTIVMSRIPRVVYGAANPKGGCSGSLMNLLQQSNFNHRAIVDKGVLKEACATLLTTFFKNLRANKKSTN

SEQ ID NO: 438 - protein, 1129 aa, Alicyclobacillus acidoterrestris
MAVKSIKVKLRLDDMPEIRAGLWKLHKEVNAGVRYYTEWLSLLRQENLYRRSPNGDGEQECDKTAEECKAELLERLRARQVENGHRGPAGSDDELLQLARQLYELLVPQAIGAKGDAQQIARKFLSPLADKDAVGGLGIAKAGNKPRWVRMREAGEPGWEEEKEKAETRKSADRTADVLRALADFGLKPLMRVYTDSEMSSVEWKPLRKGQAVRTWDRDMFQQAIERMMSWESWNQRVGQEYAKLVEQKNRFEQKNFVGQEHLVHLVNQLQQDMKEASPGLESKEQTAHYVTGRALRGSDKVFEKWGKLAPDAPFDLYDAEIKNVQRRNTRRFGSHDLFAKLAEPEYQALWREDASFLTRYAVYNSILRKLNHAKMFATFTLPDATAHPIWTRFDKLGGNLHQYTFLFNEFGERRHAIRFHKLLKVENGVAREVDDVTVPISMSEQLDNLLPRDPNEPIALYFRDYGAEQHFTGEFGGAKIQCRRDQLAHMHRRRGARDVYLNVSVRVQSQSEARGERRPPYAAVFRLVGDNHRAFVHFDKLSDYLAEHPDDGKLGSEGLLSGLRVMSVDLGLRTSASISVFRVARKDELKPNSKGRVPFFFPIKGNDNLVAVHERSQLLKLPGETESKDLRAIREERQRTLRQLRTQLAYLRLLVRCGSEDVGRRERSWAKLIEQPVDAANHMTPDWREAFENELQKLKSLHGICSDKEWMDAVYESVRRVWRHMGKQVRDWRKDVRSGERPKIRGYAKDVVGGNSIEQIEYLERQYKFLKSWSFFGKVSGQVIRAEKGSRFAITLREHIDHAKEDRLKKLADRIIMEALGYVYALDERGKGKWVAKYPPCQLILLEELSEYQFNNDRPPSENNQLMQWSHRGVFQELINQAQVHDLLVGTMYAAFSSRFDARTGAPGIRCRRVPARCTQEHNPEPFPWWLNKFVVEHTLDACPLRADDLIPTGEGEIFVSPFSAEEGDFHQIHADLNAAQNLQQRLWSDFDISQIRLRCDWGEVDGELVLIPRLTGKRTADSYSNKVFYTNTGVTYYERERGKKRRKVFAQEKLSEEEAELLVEADEAREKSVVLMRDPSGIINRGNWTRQKEFWSMVNQRIEGYLVKQIRSRVPLQDSACENTGDI

SEQ ID NO: 439 - protein, 1389 aa, Leptotrichia shahii
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTL

SEQ ID NO: 440 - protein, 1774 aa, Artificial Sequence
  Synthetic Polypeptide
SEVEFSHEYWMRHALTLAKRAWDEREVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTDSGGSSGGSSGSETPGTSESATPESSGGSSGGSSEVEFSHEYWMRHALTLAKRAWDEREVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 441 - DNA, 20 bp, Artificial Sequence
  Synthetic Polynucleotide
tacggcgtagtgcacctgga

SEQ ID NO: 442 - DNA, 20 bp, Artificial Sequence
  Synthetic Polynucleotide
atcttattcgatcatgcgaa

SEQ ID NO: 443 - DNA, 20 bp, Artificial Sequence
  Synthetic Polynucleotide
gcttaggtggagcgcctatt

SEQ ID NO: 444 - DNA, 20 bp, Artificial Sequence
  Synthetic Polynucleotide
caatgatgacttctacagcg

SEQ ID NO: 445 - DNA, 20 bp, Artificial Sequence
  Synthetic Polynucleotide
gaacacaaagcatagactgc

SEQ ID NO: 446 - DNA, 20 bp, Artificial Sequence
  Synthetic Polynucleotide
ggaacacaaagcatagactg

SEQ ID NO: 447 - DNA, 20 bp, Artificial Sequence
  Synthetic Polynucleotide
aacacaaagcatagactgcg

SEQ ID NO: 448 - DNA, 20 bp, Artificial Sequence
  Synthetic Polynucleotide
acaaagcatagactgcgggg

SEQ ID NO: 449 - DNA, 20 bp, Artificial Sequence
  Synthetic Polynucleotide
caaagcatagactgcggggc

SEQ ID NO: 450 - DNA, 20 bp, Artificial Sequence
  Synthetic Polynucleotide
gtggtaattttccagcccgc

SEQ ID NO: 451 - DNA, 20 bp, Artificial Sequence
  Synthetic Polynucleotide
cctttacagggccagcgggc

SEQ ID NO: 452 - DNA, 20 bp, Artificial Sequence
  Synthetic Polynucleotide
ctgtcacagttagctcagcc

SEQ ID NO: 453 - DNA, 20 bp, Artificial Sequence
  Synthetic Polynucleotide
gtgttccagtttcctttaca

SEQ ID NO: 454 - DNA, 20 bp, Artificial Sequence
  Synthetic Polynucleotide
gaacacaatgcatagattgc

SEQ ID NO: 455 - DNA, 20 bp, Artificial Sequence
  Synthetic Polynucleotide
gaaaaaaaagcagagactgc

SEQ ID NO: 456 - DNA, 20 bp, Artificial Sequence
  Synthetic Polynucleotide
gaatactaagcatagactcc

SEQ ID NO: 457 - DNA, 20 bp, Artificial Sequence
  Synthetic Polynucleotide
gtaaacaaagcatagactga

SEQ ID NO: 458 - DNA, 20 bp, Artificial Sequence
  Synthetic Polynucleotide
ggacacaaagcttagactcc

SEQ ID NO: 459 - DNA, 20 bp, Artificial Sequence
  Synthetic Polynucleotide
caatacaaaggatagactgc

SEQ ID NO: 460 - DNA, 20 bp, Artificial Sequence
  Synthetic Polynucleotide
gaagaccaaggatagactgc

SEQ ID NO: 461 - DNA, 20 bp, Artificial Sequence
  Synthetic Polynucleotide
gaaaacaaatcattgactgc

SEQ ID NO: 462 - DNA, 20 bp, Artificial Sequence
  Synthetic Polynucleotide
gatcacaaagcatggactga

SEQ ID NO: 463 - DNA, 20 bp, Artificial Sequence
  Synthetic Polynucleotide
gaaaacaaaacatagagtgc

SEQ ID NO: 464 - DNA, 20 bp, Artificial Sequence
  Synthetic Polynucleotide
gaacataaagaatagaatga

SEQ ID NO: 465 - DNA, 23 bp, Artificial Sequence
  Synthetic Polynucleotide
gaaaaaaaagcagagactgctgg

SEQ ID NO: 466 - DNA, 23 bp, Artificial Sequence
  Synthetic Polynucleotide
ggacacaaagcttagactccagg

SEQ ID NO: 467 - DNA, 23 bp, Artificial Sequence
  Synthetic Polynucleotide
gaaaacaaaacatagagtgctgg

SEQ ID NO: 468 - DNA, 23 bp, Artificial Sequence
  Synthetic Polynucleotide
gtcatcttagtcattacctgagg

SEQ ID NO: 469 - DNA, 23 bp, Artificial Sequence
  Synthetic Polynucleotide
gaagatagagaatagactgctgg

SEQ ID NO: 470 - DNA, 23 bp, Artificial Sequence
  Synthetic Polynucleotide
ggctaaagaccatagactgtggg

SEQ ID NO: 471 - DNA, 23 bp, Artificial Sequence
  Synthetic Polynucleotide
gagtatgaggcatagactgcagg

SEQ ID NO: 472 - DNA, 23 bp, Artificial Sequence
  Synthetic Polynucleotide
gtcaagaaagcagagactgccgg

SEQ ID NO: 473 - DNA, 23 bp, Artificial Sequence
  Synthetic Polynucleotide
gacaaagaggaagagagacgggg

SEQ ID NO: 474 - DNA, 23 bp, Artificial Sequence
  Synthetic Polynucleotide
gcctaggcagtgggggtgcaggg

SEQ ID NO: 475 - DNA, 23 bp, Artificial Sequence
  Synthetic Polynucleotide
ggggacgcgctggcttcccgggg

SEQ ID NO: 476 - DNA, 20 bp, Artificial Sequence
  Synthetic Polynucleotide
agaaaaacaattttagtatt

SEQ ID NO: 477 - DNA, 20 bp, Artificial Sequence
  Synthetic Polynucleotide
gcagaaatagactaattgca

SEQ ID NO: 478 - DNA, 20 bp, Artificial Sequence
  Synthetic Polynucleotide
gaacacaaagcatagactgc

SEQ ID NO: 479 - DNA, 20 bp, Artificial Sequence
  Synthetic Polynucleotide
gaacacaatgcatagattgc

SEQ ID NO: 480 - DNA, 20 bp, Artificial Sequence
  Synthetic Polynucleotide
ggaacacaaagcatagactg

SEQ ID NO: 481 - DNA, 20 bp, Artificial Sequence
  Synthetic Polynucleotide
aacacaaagcatagactgcg

SEQ ID NO: 482 - DNA, 20 bp, Artificial Sequence
  Synthetic Polynucleotide
acaaagcatagactgcgggg

SEQ ID NO: 483 - DNA, 20 bp, Artificial Sequence
  Synthetic Polynucleotide
caaagcatagactgcggggc

SEQ ID NO: 484 - DNA, 20 bp, Artificial Sequence
  Synthetic Polynucleotide
gtggtaattttccagcccgc

SEQ ID NO: 485 - DNA, 20 bp, Artificial Sequence
  Synthetic Polynucleotide
cctttacagggccagcgggc

SEQ ID NO: 486 - DNA, 20 bp, Artificial Sequence
  Synthetic Polynucleotide
ctgtcacagttagctcagcc

SEQ ID NO: 487 - DNA, 20 bp, Artificial Sequence
  Synthetic Polynucleotide
gtgttccagtttcctttaca

SEQ ID NO: 488 - DNA, 20 bp, Artificial Sequence
  Synthetic Polynucleotide
gaaaaaaaagcagagactgc

SEQ ID NO: 489 - DNA, 20 bp, Artificial Sequence
  Synthetic Polynucleotide
gaatactaagcatagactcc

SEQ ID NO: 490 - DNA, 20 bp, Artificial Sequence
  Synthetic Polynucleotide
gtaaacaaagcatagactga

SEQ ID NO: 491 - DNA, 20 bp, Artificial Sequence
  Synthetic Polynucleotide
ggacacaaagcttagactcc

SEQ ID NO: 492 - DNA, 20 bp, Artificial Sequence
  Synthetic Polynucleotide
caatacaaaggatagactgc

SEQ ID NO: 493 - DNA, 20 bp, Artificial Sequence
  Synthetic Polynucleotide
gaagaccaaggatagactgc

SEQ ID NO: 494 - DNA, 20 bp, Artificial Sequence
  Synthetic Polynucleotide
gaaaacaaatcattgactgc

SEQ ID NO: 495 - DNA, 20 bp, Artificial Sequence
  Synthetic Polynucleotide
gatcacaaagcatggactga

SEQ ID NO: 496 - DNA, 20 bp, Artificial Sequence
  Synthetic Polynucleotide
gaaaacaaaacatagagtgc

SEQ ID NO: 497 - DNA, 20 bp, Artificial Sequence
  Synthetic Polynucleotide
gaacataaagaatagaatga

SEQ ID NO: 498 - DNA, 20 bp, Artificial Sequence
  Synthetic Polynucleotide
aatcaagataaggctcttag

SEQ ID NO: 499 - DNA, 21 bp, Artificial Sequence
  Synthetic Polynucleotide
gctcaccctctaaagctgaaa

SEQ ID NO: 500 - DNA, 21 bp, Artificial Sequence
  Synthetic Polynucleotide
gtatatgcatatttattacat

SEQ ID NO: 501 - DNA, 21 bp, Artificial Sequence
  Synthetic Polynucleotide
gcagctacacagggcaggtct

SEQ ID NO: 502 - DNA, 21 bp, Artificial Sequence
  Synthetic Polynucleotide
gacctcacttagtgctccctg

SEQ ID NO: 503 - DNA, 20 bp, Artificial Sequence
  Synthetic Polynucleotide
ggacaggcagcatagactgt

SEQ ID NO: 504 - DNA, 20 bp, Artificial Sequence
  Synthetic Polynucleotide
gtagaaaaagtatagactgc

SEQ ID NO: 505 - DNA, 20 bp, Artificial Sequence
  Synthetic Polynucleotide
ggagagagagcatagactgc

SEQ ID NO: 506 - DNA, 20 bp, Artificial Sequence
  Synthetic Polynucleotide
gaagatagagaatagactgc

SEQ ID NO: 507 - DNA, 20 bp, Artificial Sequence
  Synthetic Polynucleotide
ggctaaagaccatagactgt

SEQ ID NO: 508 - DNA, 20 bp, Artificial Sequence
  Synthetic Polynucleotide
gtctagaaagcttagactgc

SEQ ID NO: 509 - DNA, 20 bp, Artificial Sequence
  Synthetic Polynucleotide
gagtatgaggcatagactgc

SEQ ID NO: 510 - DNA, 20 bp, Artificial Sequence
  Synthetic Polynucleotide
gtcaagaaagcagagactgc

SEQ ID NO: 511 - DNA, 20 bp, Artificial Sequence
  Synthetic Polynucleotide
gggaataaatcatagaatcc

SEQ ID NO: 512 - DNA, 20 bp, Artificial Sequence
  Synthetic Polynucleotide
gagcaaagacaatacactgt

SEQ ID NO: 513 - DNA, 20 bp, Artificial Sequence
  Synthetic Polynucleotide
gacaaagaggaagagagacg

SEQ ID NO: 514 - DNA, 20 bp, Artificial Sequence
  Synthetic Polynucleotide
ggggacgcgctggcttcccg

SEQ ID NO: 515 - DNA, 20 bp, Artificial Sequence
  Synthetic Polynucleotide
ggaccggctccctggcggtc

SEQ ID NO: 516 - DNA, 20 bp, Artificial Sequence
  Synthetic Polynucleotide
gccacttctaagcccttgat

SEQ ID NO: 517 - DNA, 20 bp, Artificial Sequence
  Synthetic Polynucleotide
gggaaagacccagcatccgt

SEQ ID NO: 518 - DNA, 20 bp, Artificial Sequence
  Synthetic Polynucleotide
gcggtacgccgcttcagtga

SEQ ID NO: 519 - DNA, 20 bp, Artificial Sequence
  Synthetic Polynucleotide
gaaactggtcccgtttacag

SEQ ID NO: 520 - DNA, 20 bp, Artificial Sequence
  Synthetic Polynucleotide
gatgagataatgatgagtca

SEQ ID NO: 521 - DNA, 20 bp, Artificial Sequence
  Synthetic Polynucleotide
gcctaggcagtgggggtgca

SEQ ID NO: 522 - DNA, 21 bp, Artificial Sequence
  Synthetic Polynucleotide
gactcagataagatgctgagg

SEQ ID NO: 523 - DNA, 21 bp, Artificial Sequence
  Synthetic Polynucleotide
gcatatgtaacagttcctgca

SEQ ID NO: 524 - DNA, 20 bp, Artificial Sequence
  Synthetic Polynucleotide
gtgcatgtttgtgcctgtcc

SEQ ID NO: 525 - DNA, 20 bp, Artificial Sequence
  Synthetic Polynucleotide
ggggatggcagggcaggaag

SEQ ID NO: 526 - DNA, 20 bp, Artificial Sequence
  Synthetic Polynucleotide
gggttaggggccccaggccg

SEQ ID NO: 527 - DNA, 20 bp, Artificial Sequence
  Synthetic Polynucleotide
ggatgcagctcgttaccacc

SEQ ID NO: 528 - DNA, 20 bp, Artificial Sequence
  Synthetic Polynucleotide
gcgcacggtggcggggtccc

SEQ ID NO: 529 - DNA, 20 bp, Artificial Sequence
  Synthetic Polynucleotide
gggccaggtccctcctctcc

SEQ ID NO: 530 - DNA, 20 bp, Artificial Sequence
  Synthetic Polynucleotide
ggattgacccaggccagggc

SEQ ID NO: 531 - DNA, 20 bp, Artificial Sequence
  Synthetic Polynucleotide
gatgacaggcaggggcaccg

SEQ ID NO: 532 - DNA, 20 bp, Artificial Sequence
  Synthetic Polynucleotide
gggccagtgaaatcaccctg

SEQ ID NO: 533 - DNA, 20 bp, Artificial Sequence
  Synthetic Polynucleotide
ggggactttgggaggtgatc

SEQ ID NO: 534 - DNA, 20 bp, Artificial Sequence
  Synthetic Polynucleotide
gcaccagcagatgcagtgtc

SEQ ID NO: 535 - DNA, 21 bp, Artificial Sequence
  Synthetic Polynucleotide
gacacacacacttagaatctg

SEQ ID NO: 536 - DNA, 21 bp, Artificial Sequence
  Synthetic Polynucleotide
gcacacacacttagaatctgt

SEQ ID NO: 537 - DNA, 23 bp, Artificial Sequence
  Synthetic Polynucleotide
gaacacaaagcatagactgctgg

SEQ ID NO: 538 - DNA, 23 bp, Artificial Sequence
  Synthetic Polynucleotide
gaaaaaaaagcagagactgctgg

SEQ ID NO: 539 - DNA, 23 bp, Artificial Sequence
  Synthetic Polynucleotide
gaatactaagcatagactccagg

SEQ ID NO: 540 - DNA, 23 bp, Artificial Sequence
  Synthetic Polynucleotide
gtaaacaaagcatagactgaggg

SEQ ID NO: 541 - DNA, 23 bp, Artificial Sequence
  Synthetic Polynucleotide
gaagaccaaggatagactgctgg

SEQ ID NO: 542 - DNA, 23 bp, Artificial Sequence
  Synthetic Polynucleotide
gaacataaagaatagaatgatgg

SEQ ID NO: 543 - DNA, 23 bp, Artificial Sequence
  Synthetic Polynucleotide
ggacaggcagcatagactgtggg

SEQ ID NO: 544 - DNA, 23 bp, Artificial Sequence
  Synthetic Polynucleotide
gtagaaaaagtatagactgcagg

SEQ ID NO: 545 - DNA, 23 bp, Artificial Sequence
  Synthetic Polynucleotide
ggagagagagcatagactgctgg

SEQ ID NO: 546 - DNA, 23 bp, Artificial Sequence
  Synthetic Polynucleotide
gaagatagagaatagactgctgg

SEQ ID NO: 547 - DNA, 23 bp, Artificial Sequence
  Synthetic Polynucleotide
ggctaaagaccatagactgtggg

SEQ ID NO: 548 - DNA, 23 bp, Artificial Sequence
  Synthetic Polynucleotide
gtctagaaagcttagactgctgg

SEQ ID NO: 549 - DNA, 23 bp, Artificial Sequence
  Synthetic Polynucleotide
gagtatgaggcatagactgcagg

SEQ ID NO: 550 - DNA, 23 bp, Artificial Sequence
  Synthetic Polynucleotide
gtcaagaaagcagagactgccgg

SEQ ID NO: 551 - DNA, 23 bp, Artificial Sequence
  Synthetic Polynucleotide
gggaataaatcatagaatcctgg

SEQ ID NO: 552 - DNA, 23 bp, Artificial Sequence
  Synthetic Polynucleotide
gagcaaagagaatagactgtagg

SEQ ID NO: 553 - DNA, 20 bp, Artificial Sequence
  Synthetic Polynucleotide
gaacacaaagcatagactgc

SEQ ID NO: 554 - DNA, 20 bp, Artificial Sequence
  Synthetic Polynucleotide
ggacaggcagcatagactgt

SEQ ID NO: 555 - DNA, 20 bp, Artificial Sequence
  Synthetic Polynucleotide
gaagatagagaatagactgc

SEQ ID NO: 556 - DNA, 20 bp, Artificial Sequence
  Synthetic Polynucleotide
gcctaggcagtgggggtgca

SEQ ID NO: 557 - DNA, 20 bp, Artificial Sequence
  Synthetic Polynucleotide
gacaaagaggaagagagacg

SEQ ID NO: 558 - DNA, 20 bp, Artificial Sequence
  Synthetic Polynucleotide
ggagagagagcatagactgc

SEQ ID NO: 559 - DNA, 20 bp, Artificial Sequence
  Synthetic Polynucleotide
ggctaaagaccatagactgt

SEQ ID NO: 560 - DNA, 20 bp, Artificial Sequence
  Synthetic Polynucleotide
gagtatgaggcatagactgc

SEQ ID NO: 561 - DNA, 23 bp, Artificial Sequence
  Synthetic Polynucleotide
gatgagataatgatgagtcaggg

SEQ ID NO: 562 - DNA, 23 bp, Artificial Sequence
  Synthetic Polynucleotide
acacacacacttagaatctctgg

SEQ ID NO: 563 - DNA, 23 bp, Artificial Sequence
  Synthetic Polynucleotide
cacacacacttagaatctgtggg

SEQ ID NO: 564 - DNA, 23 bp, Artificial Sequence
  Synthetic Polynucleotide
gtctagaaagcttagactgctgg

SEQ ID NO: 565 - DNA, 20 bp, Artificial Sequence
  Synthetic Polynucleotide
ttcattaactgtggccggct

SEQ ID NO: 566 - DNA, 20 bp, Artificial Sequence
  Synthetic Polynucleotide
atcttattcgatcatgcgaa

SEQ ID NO: 567 - DNA, 23 bp, Artificial Sequence
  Synthetic Polynucleotide
gagcaaagagaatagactgtagg

SEQ ID NO: 568 - DNA, 23 bp, Artificial Sequence
  Synthetic Polynucleotide
gtctagaaagcttagactgctgg

SEQ ID NO: 569 - DNA, 23 bp, Artificial Sequence
  Synthetic Polynucleotide
ggggactttgggaggtgatcagg

SEQ ID NO: 570 - DNA, 23 bp, Artificial Sequence
  Synthetic Polynucleotide
tacggcgtagtgcacctggatgg

SEQ ID NO: 571 - DNA, 23 bp, Artificial Sequence
  Synthetic Polynucleotide
gaacacaatgcatagattgctgg

SEQ ID NO: 572 - DNA, 23 bp, Artificial Sequence
  Synthetic Polynucleotide
gatcacaaagcatggactgaagg

SEQ ID NO: 573 - DNA, 23 bp, Artificial Sequence
  Synthetic Polynucleotide
gaacacaaagcatagactgcggg

SEQ ID NO: 574 - DNA, 23 bp, Artificial Sequence
  Synthetic Polynucleotide
gaaaaaaaagcagagactgctgg

SEQ ID NO: 575 - DNA, 23 bp, Artificial Sequence
  Synthetic Polynucleotide
gaatactaagcatagactccagg

SEQ ID NO: 576 - DNA, 23 bp, Artificial Sequence
  Synthetic Polynucleotide
gtaaacaaagcatagactgaggg

SEQ ID NO: 577 - DNA, 23 bp, Artificial Sequence
  Synthetic Polynucleotide
gaagaccaaggatagactgctgg

SEQ ID NO: 578 - DNA, 23 bp, Artificial Sequence
  Synthetic Polynucleotide
gaacataaagaatagaatgatgg

SEQ ID NO: 579 - DNA, 23 bp, Artificial Sequence
  Synthetic Polynucleotide
ggagagagagcatagactgctgg

SEQ ID NO: 580 - DNA, 23 bp, Artificial Sequence
  Synthetic Polynucleotide
gaagatagagaatagactgctgg

SEQ ID NO: 581 - DNA, 23 bp, Artificial Sequence
  Synthetic Polynucleotide
gtagaaaaagtatagactgcagg

SEQ ID NO: 582 - DNA, 23 bp, Artificial Sequence
  Synthetic Polynucleotide
gtcaagaaagcagagactgccgg

SEQ ID NO: 583 - DNA, 23 bp, Artificial Sequence
  Synthetic Polynucleotide
gagtatgaggcatagactgcagg

SEQ ID NO: 584 - DNA, 23 bp, Artificial Sequence
  Synthetic Polynucleotide
gtctagaaagcttagactgctgg

SEQ ID NO: 585 - DNA, 23 bp, Artificial Sequence
  Synthetic Polynucleotide
ggacaggcagcatagactgtggg

SEQ ID NO: 586 - DNA, 23 bp, Artificial Sequence
  Synthetic Polynucleotide
gagcaaagagaatagactgtagg

SEQ ID NO: 587 - DNA, 23 bp, Artificial Sequence
  Synthetic Polynucleotide
ggctaaagaccatagactgtggg

SEQ ID NO: 588 - DNA, 23 bp, Artificial Sequence
  Synthetic Polynucleotide
gggaataaatcatagaatcctgg

SEQ ID NO: 589 - DNA, 197 bp, Artificial Sequence
  Synthetic Polynucleotide
atcgacgccacgttgtatgtcacgcttgaaccatgtgtaatgtgtgccggagcgatgatccacagtcgcattggtcgcgtggtctttggtgcgcgtgacgcgaaaactggcgctgcgggatctttaatggatgtgctgcatcatccgggtatgaatcaccgagtggaaattacggaaggaatactggcggatgagtg

SEQ ID NO: 590 - protein, 66 aa, Artificial Sequence
  Synthetic Polypeptide
IDATLYVTLEPCVMCAGAMIHSRIGRVVFGARDAKTGAAGSLMDVLHHPGMNHRVEITEGILADEC

SEQ ID NO: 591 - DNA, 197 bp, Artificial Sequence; identical to SEQ ID NO: 589
  Synthetic Polynucleotide

SEQ ID NO: 592 - protein, 66 aa, Artificial Sequence; identical to SEQ ID NO: 590
  Synthetic Polypeptide

SEQ ID NO: 593 - DNA, 197 bp, Artificial Sequence
  Synthetic Polynucleotide
atcgacgccacgttgtatgtcacgcttgaaccatgtgtaatgtgtgccggagcgatgatccacagtcgcattggtcgcgtggtctttggtgcgtgtgacgcgaaaactggcgctgcgggatctttaatggatgtgctgcatcatccgggtatgaatcaccgagtggaaattacggaaggaatactggcggatgagtg

SEQ ID NO: 594 - protein, 66 aa, Artificial Sequence
  Synthetic Polypeptide
IDATLYVTLEPCVMCAGAMIHSRIGRVVFGACDAKTGAAGSLMDVLHHPGMNHRVEITEGILADEC

SEQ ID NO: 595 - DNA, 197 bp, Artificial Sequence
  Synthetic Polynucleotide
atcgacgccacgttgtatgtcacgcttgaaccatgtgtaatgtgtgccggagcgatgatccacagtcgcattggtcgcgtggtctttggtgcgcgtaacgcgaaaactggcgctgcgggatctttaatggatgtgctgcatcatccgggtatgagtcaccgagtggaaattacggaaggaatactggcggatgagtg

SEQ ID NO: 596 - protein, 66 aa, Artificial Sequence
  Synthetic Polypeptide
IDATLYVTLEPCVMCAGAMIHSRIGRVVFGARNAKTGAAGSLMDVLHHPGMSHRVEITEGILADEC

SEQ ID NO: 597 - DNA, 197 bp, Artificial Sequence
  Synthetic Polynucleotide
atcgacgccacgttgtatgtcacgcttgaaccatgtgtaatgtgtgccggagcgatgatccacagtcgcattggtcgcgtggtctttggtgcgcgtggcgcgaaaactggcgctgcgggatctttaatggatgtgctgcatcatccgggtatgaatcaccgagtggaaattacggaaggaatactggcggatgagtg

SEQ ID NO: 598 - protein, 66 aa, Artificial Sequence
  Synthetic Polypeptide
IDATLYVTLEPCVMCAGAMIHSRIGRVVFGARGAKTGAAGSLMDVLHHPGMNHRVEITEGILADEC

SEQ ID NO: 599 - DNA, 197 bp, Artificial Sequence; identical to SEQ ID NO: 597
  Synthetic Polynucleotide

SEQ ID NO: 600 - protein, 66 aa, Artificial Sequence; identical to SEQ ID NO: 598
  Synthetic Polypeptide

SEQ ID NO: 601 - DNA, 197 bp, Artificial Sequence
  Synthetic Polynucleotide
atcgacgccacgttgtatgtcacgcttgaaccatgtgtaatgtgtgccggagcgatgatccacagtcgcattggtcgcgtggtctttggtgtgcgtaacgcgaaaactggcgctgcgggatctttaatggatgtgctgcatcatccgggtatgaatcaccgagtggaaattacggagggaatactggcggatgagtg

SEQ ID NO: 602 - protein, 66 aa, Artificial Sequence
  Synthetic Polypeptide
IDATLYVTLEPCVMCAGAMIHSRIGRVVFGVRNAKTGAAGSLMDVLHHPGMNHRVEITEGILADEC

SEQ ID NO: 603 - DNA, 197 bp, Artificial Sequence; identical to SEQ ID NO: 597
  Synthetic Polynucleotide

SEQ ID NO: 604 - protein, 66 aa, Artificial Sequence; identical to SEQ ID NO: 598
  Synthetic Polypeptide

SEQ ID NO: 605 - DNA, 197 bp, Artificial Sequence; identical to SEQ ID NO: 601
  Synthetic Polynucleotide

SEQ ID NO: 606 - protein, 66 aa, Artificial Sequence; identical to SEQ ID NO: 602
  Synthetic Polypeptide

SEQ ID NO: 607 - DNA, 197 bp, Artificial Sequence; identical to SEQ ID NO: 597
  Synthetic Polynucleotide

SEQ ID NO: 608 - DNA, 192 bp, Artificial Sequence
  Synthetic Polynucleotide
accgagtggaaattacggaaggaatactggcggatgagtgcgcggcgttgctcagtgacttctttcgcatgcgccgccaggwaattaaagcgcagaaaaaagcgcaatcctcgacggattccggtagcgaaacaccggggacttcagaatcggccaccccggagtctgataagaaatactcaataggcttag

SEQ ID NO: 609 - protein, 65 aa, Artificial Sequence
  Synthetic Polypeptide
HRVEITEGILADECAALLSDFFRMRRQEVIKAQKKAQSSTDSGSETPGTSESATPESDKKYSIGL

SEQ ID NO: 610 - DNA, 192 bp, Artificial Sequence
  Synthetic Polynucleotide
accgagtggaaattacggaaggaatactggcggatgagtgcgcggcgttgctcagtgacttctttcgcatgcgccgccaggaaattaaagcgcagaaaaaagcgcaatcctcgacggattccggtagcgaaacaccggggacttcagaatcggccaccccggagtctgataagaaatactcaataggcttag

SEQ ID NO: 611 - protein, 64 aa, Artificial Sequence
  Synthetic Polypeptide
HRVEITEGILADECAALLSDFFRMRRQEIKAQKKAQSSTDSGSETPGTSESATPESDKKYSIGL

SEQ ID NO: 612 - DNA, 192 bp, Artificial Sequence
  Synthetic Polynucleotide
accgagtggaaattacggaaggaatactggctgatgagtgcgcggcgttgctcagtgacttctttcgcatgcgccgccaggatattaaagcgcagaaacaagcgcaatcctcgacggattccggtagcgaaacaccggggacttcagaatcggccaccccggagtctgataagaaatactcaataggcttag

SEQ ID NO: 613 - protein, 64 aa, Artificial Sequence
  Synthetic Polypeptide
HRVEITEGILADECAALLSDFFRMRRQDIKAQKQAQSSTDSGSETPGTSESATPESDKKYSIGL

SEQ ID NO: 614 - DNA, 192 bp, Artificial Sequence
  Synthetic Polynucleotide
accgagtggaaattacagaaggaatactggcggatgagtgcgcggcgttgctcagtgacttctttcgcatgtgccgccatgaaattaaagcgcagaaaaaagcgcaatcctcgacggattccggtagcgaaacaccggggacttcagaatcggccaccccggagtctgataagaaatactcaataggcttag

SEQ ID NO: 615 - protein, 64 aa, Artificial Sequence
  Synthetic Polypeptide
HRVEITEGILADECAALLSDFFRMCRHEIKAQKKAQSSTDSGSETPGTSESATPESDKKYSIGL

SEQ ID NO: 616 - DNA, 192 bp, Artificial Sequence
  Synthetic Polynucleotide
accgagtggaaattacggaaggaatactggcggatgagtgcgcggcgttgctcagtgacttctttcgcatgcgccgccggggaattaaagcgcagaaaaaagcgcattcctcgacggattccggtagcgaaacaccggggacttcagaatcggccaccccggagtctgataagaaatactcaataggcttag

SEQ ID NO: 617 - protein, 64 aa, Artificial Sequence
  Synthetic Polypeptide
HRVEITEGILADECAALLSDFFRMRRRGIKAQKKAHSSTDSGSETPGTSESATPESDKKYSIGL

SEQ ID NO: 618 - DNA, 192 bp, Artificial Sequence; identical to SEQ ID NO: 612
  Synthetic Polynucleotide

SEQ ID NO: 619 - protein, 64 aa, Artificial Sequence; identical to SEQ ID NO: 613
  Synthetic Polypeptide

SEQ ID NO: 620 - DNA, 192 bp, Artificial Sequence
  Synthetic Polynucleotide
accgagtggaaattacggaaggaatactggcggatgagtgcgcggcgttgctcagtgacttctttcgcatgcgccgccaggtaattaaagcgcagaaaaaagcgcaatcctcgccggattccggtagcgaaacaccggggacttcagaatcggccaccccggagtctgataagaaatactcaataggcttag

SEQ ID NO: 621 - protein, 64 aa, Artificial Sequence
  Synthetic Polypeptide
HRVEITEGILADECAALLSDFFRMRRQVIKAQKKAQSSPDSGSETPGTSESATPESDKKYSIGL

SEQ ID NO: 622 - DNA, 192 bp, Artificial Sequence
  Synthetic Polynucleotide
accgagtggaaattacggaaggaatactggcggatgagtgcgcggcgttgctcagttacttctttcgcatgcgccgccaggtaattaaagcgcagaaaaaagcgcaatcctcgacggattccggtagcgaaacaccggggacttcagaatcggccaccccggagtctgataagaaatactcaataggcttag

SEQ ID NO: 623 - protein, 64 aa, Artificial Sequence
  Synthetic Polypeptide
HRVEITEGILADECAALLSYFFRMRRQVIKAQKKAQSSTDSGSETPGTSESATPESDKKYSIGL

SEQ ID NO: 624 - DNA, 60 bp, Artificial Sequence
  Synthetic Polynucleotide
gacaggatgaggatcctttcgcatgatcgaacaagatggattgcacgcaggttctccggc

SEQ ID NO: 625 - protein, 13 aa, Artificial Sequence
  Synthetic Polypeptide
MIEQDGLHAGSPA

SEQ ID NO: 626 - DNA, 60 bp, Artificial Sequence
  Synthetic Polynucleotide
gacaggatgaggatcctttcgcatgatcgaataagatggattgcacgcaggttctccggc

SEQ ID NO: 627 - protein, 3 aa, Artificial Sequence
  Synthetic Polypeptide
MIE

SEQ ID NO: 628 - DNA, 60 bp, Artificial Sequence; identical to SEQ ID NO: 624
  Synthetic Polynucleotide

SEQ ID NO: 629 - DNA, 81 bp, Artificial Sequence
  Synthetic Polynucleotide
atgattgaacaagatggattgcacgcaggttctccggccgcttgggtggagcgcctattcggctatgactgggcacaacag

SEQ ID NO: 630 - protein, 27 aa, Artificial Sequence
  Synthetic Polypeptide
MIEQDGLHAGSPAAWVERLFGYDWAQQ

SEQ ID NO: 631 - DNA, 81 bp, Artificial Sequence
  Synthetic Polynucleotide
atgattgaacaagatggattgcacgcaggttctccggccgcttaggtggagcgcctattcggctatgactgggcacaacag

SEQ ID NO: 632 - protein, 14 aa, Artificial Sequence
  Synthetic Polypeptide
MIEQDGLHAGSPAA

SEQ ID NO: 633 - DNA, 81 bp, Artificial Sequence; identical to SEQ ID NO: 629
  Synthetic Polynucleotide

SEQ ID NO: 634 - protein, 63 aa, Artificial Sequence
  Synthetic Polypeptide
  misc_feature (9)..(11): Xaa can be any naturally occurring amino acid
  misc_feature (14)..(14): Xaa can be any naturally occurring amino acid
  misc_feature (17)..(17): Xaa can be any naturally occurring amino acid
  MISC_FEATURE (27)..(27): X can be Ile or Leu
  misc_feature (28)..(29): Xaa can be any naturally occurring amino acid
  misc_feature (36)..(36): Xaa can be any naturally occurring amino acid
  misc_feature (47)..(47): Xaa can be any naturally occurring amino acid
  misc_feature (54)..(54): Xaa can be any naturally occurring amino acid
  misc_feature (56)..(56): Xaa can be any naturally occurring amino acid
  misc_feature (62)..(62): Xaa can be any naturally occurring amino acid
MPPAFITMXXXKSXVEXDDEYWMRHAXXXAKKAEAXGEVPVGAVLVXDGRVIGXGXNLRIGXH

SEQ ID NO: 635 - protein, 52 aa, Artificial Sequence
  Synthetic Polypeptide
MSEVEFSHEYWMRHALTLAKRAWDEREVPVGAVLVHNNRVIGEGWNRPIGRH

SEQ ID NO: 636 - protein, 51 aa, Artificial Sequence
  Synthetic Polypeptide
MSHMTNDIYFMTLAIEEAKKAAQLGEVPIGAIITKDDEVIARAHNLRETLQ

SEQ ID NO: 637 - protein, 63 aa, Artificial Sequence
  Synthetic Polypeptide
MPPAFITGVTSLSDVELDHEYWMRHALTLAKRAWDEREVPVGAVLVHNHRVIGEGWNRPIGRH

SEQ ID NO: 638 - protein, 56 aa, Artificial Sequence
  Synthetic Polypeptide
MDAAKVRSEFDEKMMRYALELADKAEALGEIPVGAVLVDDARNIIGEGWNLSIVQS

SEQ ID NO: 639 - protein, 46 aa, Artificial Sequence
  Synthetic Polypeptide
MDEYWMQVAMQMAEKAEAAGEVPVGAVLVKDGQQIATGYNLSISQH

SEQ ID NO: 640 - protein, 48 aa, Artificial Sequence
  Synthetic Polypeptide
MTQDELYMKEAIKEAKKAEEKGEVPIGAVLVINGEIIARAHNLRETEQ

SEQ ID NO: 641 - protein, 56 aa, Artificial Sequence
  Synthetic Polypeptide
MSSLKKTPIRDDAYWMGKAIREAAKAAARDEVPIGAVIVRDGAVIGRGHNLREGSN

SEQ ID NO: 642 - protein, 64 aa, Artificial Sequence
  Synthetic Polypeptide
  misc_feature (15)..(15): Xaa can be any naturally occurring amino acid
  misc_feature (25)..(25): Xaa can be any naturally occurring amino acid
  misc_feature (42)..(42): Xaa can be any naturally occurring amino acid
  misc_feature (48)..(48): Xaa can be any naturally occurring amino acid
DPTAHAEIIALRQAXKVLQNYRLLXATLYVTLEPCVMCAGAXVHSRIXRVVFGARDPKTGAAGS

SEQ ID NO: 643 - protein, 64 aa, Artificial Sequence
  Synthetic Polypeptide
DPTAHAEIMALRQGGLVMQNYRLIDATLYVTLEPCVMCAGAMIHSRIGRVVFGARDAKTGAAGS

SEQ ID NO: 644 - protein, 64 aa, Artificial Sequence
  Synthetic Polypeptide
QPTAHAEHIAIERAAKVLGSWRLEGCTLYVTLEPCVMCAGTIVMSRIPRVVYGADDPKGGCSGS

SEQ ID NO: 645 - protein, 64 aa, Artificial Sequence
  Synthetic Polypeptide
DPTAHAEIMALRQGGLVLQNYRLLDTTLYVTLEPCVMCAGAMVHSRIGRVVFGARDAKTGAAGS

SEQ ID NO: 646 - protein, 64 aa, Artificial Sequence
  Synthetic Polypeptide
DPTAHAEIIALRNGAKNIQNYRLLNSTLYVTLEPCTMCAGAILHSRIKRLVFGASDYKTGAIGS

SEQ ID NO: 647 - protein, 64 aa, Artificial Sequence
  Synthetic Polypeptide
DPTAHAEILCLRSAGKKLENYRLLDATLYITLEPCAMCAGAMVHSRIARVVYGARDEKTGAAGT

SEQ ID NO: 648 - protein, 64 aa, Artificial Sequence
  Synthetic Polypeptide
RSIAHAEMLVIDEACKALGTWRLEGATLYVTLEPCPMCAGAVVLSRVEKVVFGAFDPKGGCSGT

SEQ ID NO: 649 - protein, 64 aa, Artificial Sequence
  Synthetic Polypeptide
DPSAHAEMIAIRQAARRSANWRLTGATLYVTLEPCLMCMGAIILARLERVVFGCYDPKGGAAGS

SEQ ID NO: 650 - protein, 56 aa, Artificial Sequence
  Synthetic Polypeptide
  misc_feature (9)..(10): Xaa can be any naturally occurring amino acid
  misc_feature (13)..(13): Xaa can be any naturally occurring amino acid
  misc_feature (16)..(16): Xaa can be any naturally occurring amino acid
  misc_feature (43)..(43): Xaa can be any naturally occurring amino acid
  misc_feature (45)..(45): Xaa can be any naturally occurring amino acid
  misc_feature (47)..(47): Xaa can be any naturally occurring amino acid
  misc_feature (49)..(49): Xaa can be any naturally occurring amino acid
  misc_feature (53)..(54): Xaa can be any naturally occurring amino acid
LMBLLQHPXXNHXVEXTSGVLAEECSTLLSDFFRMRRQEKKAXKXAXKXLSEXXAV

SEQ ID NO: 651 - protein, 51 aa, Artificial Sequence
  Synthetic Polypeptide
LMDVLHHPGMNHRVEITEGILADECAALLSDFFRMRRQEIKAQKKAQSSTD

SEQ ID NO: 652 - protein, 44 aa, Artificial Sequence
  Synthetic Polypeptide
LMNLLQQSNFNHRAIVDKGVLKEACSTLLTTFFKNLRANKKSTN

SEQ ID NO: 653 - protein, 56 aa, Artificial Sequence
  Synthetic Polypeptide
LIDVLHHPGMNHRVEIIEGVLRDECATLLSDFFRMRRQEIKALKKADRAEGAGPAV

SEQ ID NO: 654 - protein, 53 aa, Artificial Sequence
  Synthetic Polypeptide
RFHFFDDYKMNHTLEITSGVLAEECSQKLSTFFQKRREEKKIEKALLKSLSDK

SEQ ID NO: 655 - protein, 55 aa, Artificial Sequence
  Synthetic Polypeptide
VVNLLQHPAFNHQVEVTSGVLAEACSAQLSRFFEKRRRDEKKALKLAQRAQQGIE

SEQ ID NO: 656 - protein, 49 aa, Artificial Sequence
  Synthetic Polypeptide
LMNLLQEERFNHQAEVVSGVLEEECGGMLSAFFRELRKKKKAARKNLSE

SEQ ID NO: 657 - protein, 59 aa, Artificial Sequence
  Synthetic Polypeptide
LYDLSADPRLNHQVRLSPGVCQEECGTMLSDFFRDLRRRKKAKATPALFIDERKVPPEP

SEQ ID NO: 658 - DNA, 131 bp, Artificial Sequence
  Synthetic Polynucleotide
aagatctgatcaagagacaggatgaggatcctttcgcatgatcgaacaagatggattgcacgcaggttctccggccgcttgggtggagcgcctattcggctatgactgggcacaacagacaatcggctgct

SEQ ID NO: 659 - protein, 31 aa, Artificial Sequence
  Synthetic Polypeptide
MIEQDGLHAGSPAAWVERLFGYDWAQQTIGC

SEQ ID NO: 660 - DNA, 131 bp, Artificial Sequence
  Synthetic Polynucleotide
aagatctgatcaagagacaggatgaggatcctttcgcatgatcgaataagatggattgcacgcaggttctccggccgcttaggtggagcgcctattcggctatgactgggcacaacagacaatcggctgct

SEQ ID NO: 661 - protein, 3 aa, Artificial Sequence
  Synthetic Polypeptide
MIE

SEQ ID NO: 662 - DNA, 96 bp, Artificial Sequence; identical to SEQ ID NO: 361
  Synthetic Polynucleotide

SEQ ID NO: 663 - protein, 32 aa, Artificial Sequence
  Synthetic Polypeptide
TSASPGESEILRAVEVIIVVHDDIIPWRYPAK

SEQ ID NO: 664 - DNA, 96 bp, Artificial Sequence
  Synthetic Polynucleotide
cttcggcttcccctggagagagcgagattctccgcgctgtagaagtcaccattgttgtgcacgacgacatcattccgtggcgttatccagctaagc

SEQ ID NO: 665 - protein, 32 aa, Artificial Sequence
  Synthetic Polypeptide
TSASPGESEILRAVEVTIVVHDDIIPWRYPAK

SEQ ID NO: 666 - DNA, 96 bp, Artificial Sequence; identical to SEQ ID NO: 664
  Synthetic Polynucleotide

SEQ ID NO: 667 - protein, 32 aa, Artificial Sequence; identical to SEQ ID NO: 665
  Synthetic Polypeptide

SEQ ID NO: 668 - DNA, 96 bp, Artificial Sequence; identical to SEQ ID NO: 664
  Synthetic Polynucleotide

SEQ ID NO: 669 - protein, 32 aa, Artificial Sequence; identical to SEQ ID NO: 665
  Synthetic Polypeptide

SEQ ID NO: 670 - DNA, 96 bp, Artificial Sequence; identical to SEQ ID NO: 664
  Synthetic Polynucleotide

SEQ ID NO: 671 - protein, 32 aa, Artificial Sequence; identical to SEQ ID NO: 665
  Synthetic Polypeptide

SEQ ID NO: 672 - protein, 166 aa, Artificial Sequence
  Synthetic Polypeptide
SEVEFSHEYWMRHALTLAKRAWDEREVPVGAVLVHNNRVIGEGWNRSIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 673 - protein, 166 aa, Artificial Sequence
  Synthetic Polypeptide
SEVEFSHEYWMRHALTLAKRAWDEREVPVGAVLVHNNRVIGEGWNRTIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 674 - protein, 166 aa, Artificial Sequence
  Synthetic Polypeptide
SEVEFSHEYWMRHALTLAKRAWDEREVPVGAVLVHNNRVIGEGWNRAIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 675 - protein, 166 aa, Artificial Sequence
  Synthetic Polypeptide
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECNALLSDFFRMRRQEIKAQKKAQSSTD

SEQ ID NO: 676 - protein, 166 aa, Artificial Sequence
  Synthetic Polypeptide
SEVEFSHEYWMRHALTLAKRARDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 677 - protein, 166 aa, Artificial Sequence
  Synthetic Polypeptide
SEVEFSHEYWMRHALTLAKRALDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 678 - protein, 166 aa, Artificial Sequence
  Synthetic Polypeptide
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMPRQEIKAQKKAQSSTD

SEQ ID NO: 679 - protein, 166 aa, Artificial Sequence
  Synthetic Polypeptide
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMHRQEIKAQKKAQSSTD

SEQ ID NO: 680 - protein, 166 aa, Artificial Sequence; identical to SEQ ID NO: 73
  Synthetic Polypeptide

SEQ ID NO: 681 - protein, 166 aa, Artificial Sequence
  Synthetic Polypeptide
SEVEFSHEYWMRHALTLAKRAWDEREVPVGAVLVLNNRVIGEGWNRPIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTD

SEQ ID NO: 682 - protein, 166 aa, Artificial Sequence
  Synthetic Polypeptide
SEVEFSHEYWMRHALTLAKRAWDEREVPVGAVLVLNNRVIGEGWNRSIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTD

SEQ ID NO: 683 - protein, 166 aa, Artificial Sequence
  Synthetic Polypeptide
SEVEFSHEYWMRHALTLAKRAWDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTD

SEQ ID NO: 684 - protein, 166 aa, Artificial Sequence
  Synthetic Polypeptide
SEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 685 - protein, 24 aa, Artificial Sequence
  Synthetic Polypeptide
SGGSSGGSSGSETPGTSESATPES

SEQ ID NO: 686 - protein, 40 aa, Artificial Sequence
  Synthetic Polypeptide
SGGSSGGSSGSETPGTSESATPESSGGSSGGSSGGSSGGS

SEQ ID NO: 687 - protein, 64 aa, Artificial Sequence
  Synthetic Polypeptide
SGGSSGGSSGSETPGTSESATPESSGGSSGGSSGGSSGGSSGSETPGTSESATPESSGGSSGGS

SEQ ID NO: 688 - protein, 92 aa, Artificial Sequence
  Synthetic Polypeptide
PGSPAGSPTSTEEGTSESATPESGPGTSTEPSEGSAPGSPAGSPTSTEEGTSTEPSEGSAPGTSTEPSEGSAPGTSESATPESGPGSEPATS

SEQ ID NO: 689 - protein, 579 aa, Artificial Sequence
  Synthetic Polypeptide
GTTGLESLSLGDRGAAPTVTSSERLVPDPPNDLRKEDVAMELERVGEDEEQMMIKRSSECNPLLQEPIASAQFGATAGTECRKSVPCGWERVVKQRLFGKTAGRFDVYFISPQGLKFRSKSSLANYLHKNGETSLKPEDFDFTVLSKRGIKSRYKDCSMAALTSHLQNQSNNSNWNLRTRSKCKKDVFMPPSSSSELQESRGLSNFTSTHLLLKEDEGVDDVNFRKVRKPKGKVTILKGIPIKKTKKGCRKSCSGFVQSDSKRESVCNKADAESEPVAQKSQLDRTVCISDAGACGETLSVTSEENSLVKKKERSLSSGSNFCSEQKTSGIINKFCSAKDSEHNEKYEDTFLESEEIGTKVEVVERKEHLHTDILKRGSEMDNNCSPTRKDFTGEKIFQEDTIPRTQIERRKTSLYFSSKYNKEALSPPRRKAFKKWTPPRSPFNLVQETLFHDPWKLLIATIFLNRTSGKMAIPVLWKFLEKYPSAEVARTADWRDVSELLKPLGLYDLRAKTIVKFSDEYLTKQWKYPIELHGIGKYGNDSYRIFCVNEWKQVHPEDHKLNKYHDWLWENHEKLSLS

SEQ ID NO: 690 - protein, 409 aa, Artificial Sequence
  Synthetic Polypeptide
EAENAGSYSLQQAQAFYTFPFQQLMAEAPNMAVVNEQQMPEEVPAPAPAQEPVQEAPKGRKRKPRTTEPKQPVEPKKPVESKKSGKSAKSKEKQEKITDTFKVKRKVDRFNGVSEAELLTKTLPDILTFNLDIVIIGINPGLMAAYKGHHYPGPGNHFWKCLFMSGLSEVQLNHMDDHTLPGKYGIGFTNMVERTTPGSKDLSSKEFREGGRILVQKLQKYQPRIAVFNGKCIYEIFSKEVFGVKVKNLEFGLQPHKIPDTETLCYVMPSSSARCAQFPRAQDKVHYYIKLKDLRDQLKGIERNMDVQEVQYTFDLQLAQEDAKKMAVKEEKYDPGYEAAYGGAYGENPCSSEPCGFSSNGLIESVELRGESAFSGIPNGQWMTQSFTDQIPSFSNHCGTQEQEEESHA

SEQ ID NO: 691 - protein, 1775 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 692 - protein, 1767 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 693 - protein, 1775 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 694 - protein, 1775 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRPIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 695 - protein, 1767 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRPIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTDSGGSSGGSSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 696 - protein, 1775 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRSIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 697 - protein, 1775 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRSIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMRRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 698 - protein, 1775 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 699 - protein, 1775 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMRRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 700 - protein, 1775 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 701 - protein, 1775 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMRRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 702 - protein, 1775 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 703 - protein, 1775 aa, Artificial Sequence; identical to SEQ ID NO: 700
  Synthetic Polypeptide

SEQ ID NO: 704 - protein, 1767 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 705 - protein, 1767 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMPRQVFNAQKKAQSSTDSGGSSGGSSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 706 - protein, 1767 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 707 - DNA, 20 bp, Artificial Sequence
  Synthetic Polynucleotide
gcttaggtggagcgcctatt

SEQ ID NO: 708 - DNA, 20 bp, Artificial Sequence
  Synthetic Polynucleotide
agtcactccacccaagcggc

SEQ ID NO: 709 - DNA, 20 bp, Artificial Sequence
  Synthetic Polynucleotide
gtcacccctgcgctgacagc

SEQ ID NO: 710 - DNA, 20 bp, Artificial Sequence
  Synthetic Polynucleotide
atcttattcgatcatgcgaa

SEQ ID NO: 711 - DNA, 20 bp, Artificial Sequence
  Synthetic Polynucleotide
gcttaggtggagcgcctatt

SEQ ID NO: 712 - DNA, 20 bp, Artificial Sequence
  Synthetic Polynucleotide
gcttaggtggagcgcctatt

SEQ ID NO: 713 - DNA, 20 bp, Artificial Sequence
  Synthetic Polynucleotide
gcttaggtggagcgcctatt

SEQ ID NO: 714 - DNA, 20 bp, Artificial Sequence
  Synthetic Polynucleotide
atcttattcgatcatgcgaa

SEQ ID NO: 715 - DNA, 20 bp, Artificial Sequence
  Synthetic Polynucleotide
agtcactccacccaagcggc

SEQ ID NO: 716 - DNA, 20 bp, Artificial Sequence
  Synthetic Polynucleotide
gcttaggtggagcgcctatt

SEQ ID NO: 717 - DNA, 20 bp, Artificial Sequence
  Synthetic Polynucleotide
gtcacccctgcgctgacagc

SEQ ID NO: 718 - DNA, 20 bp, Artificial Sequence
  Synthetic Polynucleotide
gcttaggtggagcgcctatt

SEQ ID NO: 719 - DNA, 20 bp, Artificial Sequence
  Synthetic Polynucleotide
gtcacccctgcgctgacagc

SEQ ID NO: 720 - DNA, 20 bp, Artificial Sequence
  Synthetic Polynucleotide
tactgtgtaatgtatctgga

SEQ ID NO: 721 - DNA, 20 bp, Artificial Sequence
  Synthetic Polynucleotide
tactgcgtagtgcacctgga

SEQ ID NO: 722 - DNA, 20 bp, Artificial Sequence
  Synthetic Polynucleotide
taccgcgtagtgcacctgga

SEQ ID NO: 723 - DNA, 20 bp, Artificial Sequence
  Synthetic Polynucleotide
tacagcgtagtgcacctgga

SEQ ID NO: 724 - DNA, 20 bp, Artificial Sequence
  Synthetic Polynucleotide
tacggcgtaatgcacctgga

SEQ ID NO: 725 - DNA, 20 bp, Artificial Sequence
  Synthetic Polynucleotide
tacggcatagtgcacctgga

SEQ ID NO: 726 - DNA, 20 bp, Artificial Sequence
  Synthetic Polynucleotide
tacggcgtagtgtacctgga

SEQ ID NO: 727 - DNA, 20 bp, Artificial Sequence
  Synthetic Polynucleotide
tacggcgtagtggacctgga

SEQ ID NO: 728 - DNA, 20 bp, Artificial Sequence
  Synthetic Polynucleotide
tacggcgtagtgaacctgga

SEQ ID NO: 729 - DNA, 20 bp, Artificial Sequence
  Synthetic Polynucleotide
tacggcgtagtgcacttgga

SEQ ID NO: 730 - DNA, 20 bp, Artificial Sequence
  Synthetic Polynucleotide
cgtagtgcacctggatggcc

SEQ ID NO: 731 - DNA, 20 bp, Artificial Sequence
  Synthetic Polynucleotide
taccgcgtagtgaacttgga

SEQ ID NO: 732 - DNA, 20 bp, Artificial Sequence
  Synthetic Polynucleotide
taccgcatagtgaacttgga

SEQ ID NO: 733 - DNA, 20 bp, Artificial Sequence
  Synthetic Polynucleotide
gcttaggtggagcgcctatt

SEQ ID NO: 734 - DNA, 20 bp, Artificial Sequence
  Synthetic Polynucleotide
atcttattcgatcatgcgaa

SEQ ID NO: 735 - DNA, 20 bp, Artificial Sequence
  Synthetic Polynucleotide
tacggcgtagtgcacctgga

SEQ ID NO: 736 - DNA, 20 bp, Artificial Sequence
  Synthetic Polynucleotide
caatgatgacttctacagcg

SEQ ID NO: 737 - DNA, 20 bp, Artificial Sequence
  Synthetic Polynucleotide
tacggcgtagtgcacctgga

SEQ ID NO: 738 - DNA, 20 bp, Artificial Sequence
  Synthetic Polynucleotide
ttcattaactgtggccggct

SEQ ID NO: 739 - DNA, 20 bp, Artificial Sequence
  Synthetic Polynucleotide
atcttattcgatcatgcgaa

SEQ ID NO: 740 - DNA, 23 bp, Artificial Sequence
  Synthetic Polynucleotide
ccgagccggtgtccyggcgcact

SEQ ID NO: 741 - DNA, 23 bp, Artificial Sequence
  Synthetic Polynucleotide
cccggcgcactgagctgtycatt

SEQ ID NO: 742 - DNA, 23 bp, Artificial Sequence
  Synthetic Polynucleotide
ccggcgcactgagctgtycattg

SEQ ID NO: 743 - DNA, 23 bp, Artificial Sequence
  Synthetic Polynucleotide
gcatgcrccagtgccttgggcgg

SEQ ID NO: 744 - DNA, 23 bp, Artificial Sequence
  Synthetic Polynucleotide
tgcctrgtacccgccactgctgg

SEQ ID NO: 745 - DNA, 23 bp, Artificial Sequence
  Synthetic Polynucleotide
aacctcagrtgagggcaggcagg

SEQ ID NO: 746 - DNA, 23 bp, Artificial Sequence
  Synthetic Polynucleotide
ggtccrgacccactggctgctgg

SEQ ID NO: 747 - DNA, 23 bp, Artificial Sequence
  Synthetic Polynucleotide
ggctrcgtcagcaagatccttgg

SEQ ID NO: 748 - DNA, 23 bp, Artificial Sequence
  Synthetic Polynucleotide
cttgcrgtgggtgctggctgagg

SEQ ID NO: 749 - DNA, 23 bp, Artificial Sequence
  Synthetic Polynucleotide
gacctcgrccaagacccggcagg

SEQ ID NO: 750 - DNA, 23 bp, Artificial Sequence
  Synthetic Polynucleotide
cttrgggtaggtcatggccatgg

SEQ ID NO: 751 - DNA, 23 bp, Artificial Sequence
  Synthetic Polynucleotide
ctgrctccagctgtcgtcactgg

SEQ ID NO: 752 - DNA, 23 bp, Artificial Sequence
  Synthetic Polynucleotide
agtrggtgagcacaaaagaacgg

SEQ ID NO: 753 - DNA, 23 bp, Artificial Sequence
  Synthetic Polynucleotide
gcaarggtaccagcttagacagg

SEQ ID NO: 754 - DNA, 23 bp, Artificial Sequence
  Synthetic Polynucleotide
gtgtgrgaacgacctctctcagg

SEQ ID NO: 755 - DNA, 23 bp, Artificial Sequence
  Synthetic Polynucleotide
cccgaccrggacacgtggaaggg

SEQ ID NO: 756 - DNA, 23 bp, Artificial Sequence
  Synthetic Polynucleotide
ccccgaccrggacacgtggaagg

SEQ ID NO: 757 - DNA, 23 bp, Artificial Sequence
  Synthetic Polynucleotide
ggagrttggtctcgcaggttggg

SEQ ID NO: 758 - DNA, 23 bp, Artificial Sequence
  Synthetic Polynucleotide
gggagrttggtctcgcaggttgg

SEQ ID NO: 759 - DNA, 23 bp, Artificial Sequence
  Synthetic Polynucleotide
tcargtacctggaagctgtgagg

SEQ ID NO: 760 - DNA, 23 bp, Artificial Sequence
  Synthetic Polynucleotide
tggraggttgatacctgccgggg

SEQ ID NO: 761 - DNA, 23 bp, Artificial Sequence
  Synthetic Polynucleotide
atggraggttgatacctgccggg

SEQ ID NO: 762 - DNA, 23 bp, Artificial Sequence
  Synthetic Polynucleotide
catggraggttgatacctgccgg

SEQ ID NO: 763 - DNA, 23 bp, Artificial Sequence
  Synthetic Polynucleotide
tttccagrgatggagtctgctgg

SEQ ID NO: 764 - DNA, 23 bp, Artificial Sequence
  Synthetic Polynucleotide
ggactrtgaccagcatagaaagg

SEQ ID NO: 765 - DNA, 23 bp, Artificial Sequence
  Synthetic Polynucleotide
gcgaaaacrgcgggccccactgg

SEQ ID NO: 766 - DNA, 23 bp, Artificial Sequence
  Synthetic Polynucleotide
agtgagctrgactcctcctttgg

SEQ ID NO: 767 - DNA, 23 bp, Artificial Sequence
  Synthetic Polynucleotide
gttgttgcrccgctccacgatgg

SEQ ID NO: 768 - DNA, 23 bp, Artificial Sequence
  Synthetic Polynucleotide
gttaaatrgggaaaggtggatgg

SEQ ID NO: 769 - DNA, 23 bp, Artificial Sequence
  Synthetic Polynucleotide
ggagggcraggagcagaggtggg

SEQ ID NO: 770 - DNA, 23 bp, Artificial Sequence
  Synthetic Polynucleotide
tggagggcraggagcagaggtgg

SEQ ID NO: 771 - DNA, 23 bp, Artificial Sequence
  Synthetic Polynucleotide
tgagatcraggacttgatggtgg

SEQ ID NO: 772 - DNA, 23 bp, Artificial Sequence
  Synthetic Polynucleotide
acttcracaaggtgggccctggg

SEQ ID NO: 773 - DNA, 23 bp, Artificial Sequence
  Synthetic Polynucleotide
aacttcracaaggtgggccctgg

SEQ ID NO: 774 - DNA, 23 bp, Artificial Sequence
  Synthetic Polynucleotide
aaaggagrtgccggcatcagagg

SEQ ID NO: 775 - DNA, 23 bp, Artificial Sequence
  Synthetic Polynucleotide
gtgatcrgagacgagaactacgg

SEQ ID NO: 776 - DNA, 23 bp, Artificial Sequence
  Synthetic Polynucleotide
ggagggcraggagcagaggtggg

SEQ ID NO: 777 - DNA, 23 bp, Artificial Sequence
  Synthetic Polynucleotide
tggagggcraggagcagaggtgg

SEQ ID NO: 778 - DNA, 23 bp, Artificial Sequence
  Synthetic Polynucleotide
gtgrgtggagatgcacgttaagg

SEQ ID NO: 779 - DNA, 23 bp, Artificial Sequence
  Synthetic Polynucleotide
tcctrgcttttgtcaaggcaggg

SEQ ID NO: 780 - DNA, 23 bp, Artificial Sequence
  Synthetic Polynucleotide
gtcctrgcttttgtcaaggcagg

SEQ ID NO: 781 - DNA, 23 bp, Artificial Sequence
  Synthetic Polynucleotide
ctaragtgtaagtttcatgaggg

SEQ ID NO: 782 - DNA, 23 bp, Artificial Sequence
  Synthetic Polynucleotide
actaragtgtaagtttcatgagg

SEQ ID NO: 783 - DNA, 23 bp, Artificial Sequence
  Synthetic Polynucleotide
ggtgaccrcgtcgctggccaagg

SEQ ID NO: 784 - DNA, 23 bp, Artificial Sequence
  Synthetic Polynucleotide
ccagraagcatggggaacatggg

SEQ ID NO: 785 - DNA, 23 bp, Artificial Sequence
  Synthetic Polynucleotide
accagraagcatggggaacatgg

SEQ ID NO: 786 - DNA, 23 bp, Artificial Sequence
  Synthetic Polynucleotide
gcggcrcaacaacctgctgcagg

SEQ ID NO: 787 - DNA, 23 bp, Artificial Sequence
  Synthetic Polynucleotide
atcgrgctcatcggtcctccggg

SEQ ID NO: 788 - DNA, 23 bp, Artificial Sequence
  Synthetic Polynucleotide
gatcgrgctcatcggtcctccgg

SEQ ID NO: 789 - DNA, 23 bp, Artificial Sequence
  Synthetic Polynucleotide
aaaatctaracaaaaaaggaagg

SEQ ID NO: 790 - DNA, 23 bp, Artificial Sequence
  Synthetic Polynucleotide
ggtgcrtgcagtccggtggcagg

SEQ ID NO: 791 - DNA, 23 bp, Artificial Sequence
  Synthetic Polynucleotide
acttcrtacaggggggctcgagg

SEQ ID NO: 792 - DNA, 23 bp, Artificial Sequence
  Synthetic Polynucleotide
tccagcrctgccaagcctgctgg

SEQ ID NO: 793 - DNA, 23 bp, Artificial Sequence
  Synthetic Polynucleotide
tgccctrcgggccgggggagcgg

SEQ ID NO: 794 - DNA, 23 bp, Artificial Sequence
  Synthetic Polynucleotide
ttcaacraggccaagcccatcgg

SEQ ID NO: 795 - DNA, 23 bp, Artificial Sequence
  Synthetic Polynucleotide
aatagrccacattcaaaggatgg

SEQ ID NO: 796 - DNA, 23 bp, Artificial Sequence
  Synthetic Polynucleotide
ggagragtacagcgccatgcggg

SEQ ID NO: 797 - DNA, 23 bp, Artificial Sequence
  Synthetic Polynucleotide
aggagragtacagcgccatgcgg

SEQ ID NO: 798 - DNA, 23 bp, Artificial Sequence
  Synthetic Polynucleotide
cctctacraggaggagatgcggg

SEQ ID NO: 799 - DNA, 23 bp, Artificial Sequence
  Synthetic Polynucleotide
acctctacraggaggagatgcgg

SEQ ID NO: 800 - DNA, 23 bp, Artificial Sequence
  Synthetic Polynucleotide
tccragtgatccgtcttgctagg

SEQ ID NO: 801 - DNA, 23 bp, Artificial Sequence
  Synthetic Polynucleotide
atgggcrtaaatttgtttgctgg

SEQ ID NO: 802 - DNA, 23 bp, Artificial Sequence
  Synthetic Polynucleotide
catttcrgaacactgagccaagg

SEQ ID NO: 803 - DNA, 23 bp, Artificial Sequence
  Synthetic Polynucleotide
aactcrctccctcatttctaagg

SEQ ID NO: 804 - DNA, 23 bp, Artificial Sequence
  Synthetic Polynucleotide
gtgtrggaacgacctctctcagg

SEQ ID NO: 805 - DNA, 23 bp, Artificial Sequence
  Synthetic Polynucleotide
gaaaartataaagagtatcttgg

SEQ ID NO: 806 - DNA, 23 bp, Artificial Sequence
  Synthetic Polynucleotide
gccrgagaaaagggagaaacggg

SEQ ID NO: 807 - DNA, 23 bp, Artificial Sequence
  Synthetic Polynucleotide
agccrgagaaaagggagaaacgg

SEQ ID NO: 808 - DNA, 23 bp, Artificial Sequence
  Synthetic Polynucleotide
gggattgrgacatgtggatgcgg

SEQ ID NO: 809 - DNA, 23 bp, Artificial Sequence
  Synthetic Polynucleotide
catggaggrcttgacagccaagg

SEQ ID NO: 810 - DNA, 23 bp, Artificial Sequence
  Synthetic Polynucleotide
cctggtgrctgtgcgttctgggg

SEQ ID NO: 811 - DNA, 23 bp, Artificial Sequence
  Synthetic Polynucleotide
ccctggtgrctgtgcgttctggg

SEQ ID NO: 812 - DNA, 23 bp, Artificial Sequence
  Synthetic Polynucleotide
ctgrggggccatggatgctaagg

SEQ ID NO: 813 - DNA, 23 bp, Artificial Sequence
  Synthetic Polynucleotide
ctttgacraagctcacaacgtgg

SEQ ID NO: 814 - DNA, 23 bp, Artificial Sequence
  Synthetic Polynucleotide
agtttccraaacacagtggaagg

SEQ ID NO: 815 - DNA, 23 bp, Artificial Sequence
  Synthetic Polynucleotide
acaacatcraagtcctggagggg

SEQ ID NO: 816 - DNA, 23 bp, Artificial Sequence
  Synthetic Polynucleotide
gggcgrctgggagctgagcgtgg

SEQ ID NO: 817 - DNA, 23 bp, Artificial Sequence
  Synthetic Polynucleotide
gcagtatraggacatggtcgtgg

SEQ ID NO: 818 - DNA, 23 bp, Artificial Sequence
  Synthetic Polynucleotide
cccagacragctggagaagctgg

SEQ ID NO: 819 - DNA, 23 bp, Artificial Sequence
  Synthetic Polynucleotide
catcrgcttctcctgggtgaggg

SEQ ID NO: 820 - DNA, 23 bp, Artificial Sequence
  Synthetic Polynucleotide
gcatcrgcttctcctgggtgagg

SEQ ID NO: 821 - DNA, 23 bp, Artificial Sequence
  Synthetic Polynucleotide
tgtcrgcatcaaatccacactgg

SEQ ID NO: 822 - DNA, 23 bp, Artificial Sequence
  Synthetic Polynucleotide
aaaagctcrattttttggccggg

SEQ ID NO: 823 - DNA, 23 bp, Artificial Sequence
  Synthetic Polynucleotide
tggaacragcattttgggattgg

SEQ ID NO: 824 - DNA, 23 bp, Artificial Sequence
  Synthetic Polynucleotide
ccatgctggaggggtgatcygaa

SEQ ID NO: 825 - DNA, 23 bp, Artificial Sequence
  Synthetic Polynucleotide
ccttggatatgcgaggaygatgc

SEQ ID NO: 826 - DNA, 23 bp, Artificial Sequence
  Synthetic Polynucleotide
cctttgtccccgcaggtgaygca

SEQ ID NO: 827 - DNA, 23 bp, Artificial Sequence
  Synthetic Polynucleotide
ccagcggcacgctggcccyggtg

SEQ ID NO: 828 - DNA, 23 bp, Artificial Sequence
  Synthetic Polynucleotide
ccagggctgtgaacyaggccatc

SEQ ID NO: 829 - DNA, 23 bp, Artificial Sequence
  Synthetic Polynucleotide
ccagaagaagtaactygaacagt

SEQ ID NO: 830 - DNA, 23 bp, Artificial Sequence
  Synthetic Polynucleotide
ccctttgaagccatgycccggcg

SEQ ID NO: 831 - DNA, 23 bp, Artificial Sequence
  Synthetic Polynucleotide
cctttgaagccatgycccggcgt

SEQ ID NO: 832 - DNA, 23 bp, Artificial Sequence
  Synthetic Polynucleotide
ccggaagtcagccttgcagygag

SEQ ID NO: 833 - DNA, 23 bp, Artificial Sequence
  Synthetic Polynucleotide
ccccagctcagcaacagcaygac

SEQ ID NO: 834 - DNA, 23 bp, Artificial Sequence
  Synthetic Polynucleotide
cccagctcagcaacagcaygacg

SEQ ID NO: 835 - DNA, 23 bp, Artificial Sequence
  Synthetic Polynucleotide
ccagctcagcaacagcaygacgg

SEQ ID NO: 836 - DNA, 23 bp, Artificial Sequence
  Synthetic Polynucleotide
cctgagaaggacgtgtttcygaa

SEQ ID NO: 837 - DNA, 23 bp, Artificial Sequence
  Synthetic Polynucleotide
ccgcaaaagcctatacctygacc

SEQ ID NO: 838 - DNA, 23 bp, Artificial Sequence
  Synthetic Polynucleotide
ccgtcttgctaggattggcygaa

SEQ ID NO: 839 - DNA, 23 bp, Artificial Sequence
  Synthetic Polynucleotide
cctgcgcaggcttcyctgggagt

SEQ ID NO: 840 - DNA, 23 bp, Artificial Sequence
  Synthetic Polynucleotide
ccgctcagccaccaggcyccact

SEQ ID NO: 841 - DNA, 23 bp, Artificial Sequence
  Synthetic Polynucleotide
cctgggggacctcagagyagagt

SEQ ID NO: 842 - DNA, 23 bp, Artificial Sequence
  Synthetic Polynucleotide
ccggccgcgccgcaagaagyagg

SEQ ID NO: 843 - DNA, 23 bp, Artificial Sequence
  Synthetic Polynucleotide
ccgcgccgcaagaagyaggcgcg

SEQ ID NO: 844 - DNA, 23 bp, Artificial Sequence
  Synthetic Polynucleotide
ccccgcaggtgacgyagctggac

SEQ ID NO: 845 - DNA, 23 bp, Artificial Sequence
  Synthetic Polynucleotide
cccagcactactgtacygtgtgg

SEQ ID NO: 846 - DNA, 23 bp, Artificial Sequence
  Synthetic Polynucleotide
ccagcactactgtacygtgtgga

SEQ ID NO: 847 - DNA, 23 bp, Artificial Sequence
  Synthetic Polynucleotide
cccctaaagtcacttggygaaaa

SEQ ID NO: 848 - DNA, 23 bp, Artificial Sequence
  Synthetic Polynucleotide
ccctaaagtcacttggygaaaag

SEQ ID NO: 849 - DNA, 23 bp, Artificial Sequence
  Synthetic Polynucleotide
cctaaagtcacttggygaaaagt

SEQ ID NO: 850 - DNA, 23 bp, Artificial Sequence
  Synthetic Polynucleotide
ccgtgtaggacaggccygagaaa

SEQ ID NO: 851 - DNA, 23 bp, Artificial Sequence
  Synthetic Polynucleotide
ccattcagagcttaygagggaca

SEQ ID NO: 852 - DNA, 23 bp, Artificial Sequence
  Synthetic Polynucleotide
cccccgtgttcacayagcagcag

SEQ ID NO: 853 - DNA, 23 bp, Artificial Sequence
  Synthetic Polynucleotide
cctcacggtcttggygttgccaa

SEQ ID NO: 854 - DNA, 23 bp, Artificial Sequence
  Synthetic Polynucleotide
ccactgcgtgtggcatatcyagg

SEQ ID NO: 855 - DNA, 23 bp, Artificial Sequence
  Synthetic Polynucleotide
ccaggccccgcccttcaacyagg

SEQ ID NO: 856 - DNA, 23 bp, Artificial Sequence
  Synthetic Polynucleotide
ccccgcccttcaacyagggcttc

SEQ ID NO: 857 - DNA, 23 bp, Artificial Sequence
  Synthetic Polynucleotide
ccgacctggatggcttygatata

SEQ ID NO: 858 - DNA, 23 bp, Artificial Sequence
  Synthetic Polynucleotide
ccgccacaacctctygctcaacg

SEQ ID NO: 859 - DNA, 23 bp, Artificial Sequence
  Synthetic Polynucleotide
ccccttcatcgaggaggytgagc

SEQ ID NO: 860 - DNA, 23 bp, Artificial Sequence
  Synthetic Polynucleotide
cccttcatcgaggaggytgagcg

SEQ ID NO: 861 - DNA, 23 bp, Artificial Sequence
  Synthetic Polynucleotide
ccttcatcgaggaggytgagcgg

SEQ ID NO: 862 - DNA, 23 bp, Artificial Sequence
  Synthetic Polynucleotide
ccccatgacacctggctgcycaa

SEQ ID NO: 863 - DNA, 23 bp, Artificial Sequence
  Synthetic Polynucleotide
cccatgacacctggctgcycaag

SEQ ID NO: 864 - DNA, 23 bp, Artificial Sequence
  Synthetic Polynucleotide
ccatgacacctggctgcycaaga

SEQ ID NO: 865 - DNA, 23 bp, Artificial Sequence
  Synthetic Polynucleotide
ccagaccgtcttcttgttcytca

SEQ ID NO: 866 - DNA, 23 bp, Artificial Sequence
  Synthetic Polynucleotide
ccgtcttcttgttcytcattgcc

SEQ ID NO: 867 - DNA, 23 bp, Artificial Sequence
  Synthetic Polynucleotide
ccgtgacgtggctgcctcyggcc

SEQ ID NO: 868 - DNA, 23 bp, Artificial Sequence
  Synthetic Polynucleotide
ccggggcttccagggcygccact

SEQ ID NO: 869 - DNA, 23 bp, Artificial Sequence
  Synthetic Polynucleotide
ccacggtggggttcatgcygctg

SEQ ID NO: 870 - DNA, 23 bp, Artificial Sequence
  Synthetic Polynucleotide
ccgggaggcagaccatcagyctc

SEQ ID NO: 871 - DNA, 23 bp, Artificial Sequence
  Synthetic Polynucleotide
cctccccaggggtgygggttacc

SEQ ID NO: 872 - DNA, 23 bp, Artificial Sequence
  Synthetic Polynucleotide
cccgggggagcctgaycctggac

SEQ ID NO: 873 - DNA, 23 bp, Artificial Sequence
  Synthetic Polynucleotide
ccgggggagcctgaycctggacg

SEQ ID NO: 874 - DNA, 23 bp, Artificial Sequence
  Synthetic Polynucleotide
ccaatgcctactcacytagacat

SEQ ID NO: 875 - DNA, 23 bp, Artificial Sequence
  Synthetic Polynucleotide
ccatgtccaaacttaygctttgg

SEQ ID NO: 876 - DNA, 23 bp, Artificial Sequence
  Synthetic Polynucleotide
ccctgctaccagcatttcyggag

SEQ ID NO: 877 - DNA, 23 bp, Artificial Sequence
  Synthetic Polynucleotide
cctgctaccagcatttcyggagg

SEQ ID NO: 878 - DNA, 23 bp, Artificial Sequence
  Synthetic Polynucleotide
ccttgactgttgagcygggcctt

SEQ ID NO: 879 - DNA, 23 bp, Artificial Sequence
  Synthetic Polynucleotide
cctccttgattattaaaygacta

SEQ ID NO: 880 - DNA, 23 bp, Artificial Sequence
  Synthetic Polynucleotide
ccttgattattaaaygactaact

SEQ ID NO: 881 - DNA, 23 bp, Artificial Sequence
  Synthetic Polynucleotide
ccagagaggtctctcagggygaa

SEQ ID NO: 882 - DNA, 23 bp, Artificial Sequence
  Synthetic Polynucleotide
cccgtaaataaaccttyagacca

SEQ ID NO: 883 - DNA, 23 bp, Artificial Sequence
  Synthetic Polynucleotide
ccgtaaataaaccttyagaccag

SEQ ID NO: 884 - DNA, 23 bp, Artificial Sequence
  Synthetic Polynucleotide
cctgcagcgggtggcctyctccc

SEQ ID NO: 885 - DNA, 23 bp, Artificial Sequence
  Synthetic Polynucleotide
cctctaagagccttatctygatt

SEQ ID NO: 886 - DNA, 23 bp, Artificial Sequence
  Synthetic Polynucleotide
ccttccaaggtctcctatyagcc

SEQ ID NO: 887 - DNA, 23 bp, Artificial Sequence
  Synthetic Polynucleotide
ccaaggtctcctatyagccaatc

SEQ ID NO: 888 - DNA, 23 bp, Artificial Sequence
  Synthetic Polynucleotide
ccctgagccaaaccygggatgtc

SEQ ID NO: 889 - DNA, 23 bp, Artificial Sequence
  Synthetic Polynucleotide
ccctgctgcacatcgacygacat

SEQ ID NO: 890 - DNA, 23 bp, Artificial Sequence
  Synthetic Polynucleotide
cctgctgcacatcgacygacatc

SEQ ID NO: 891 - DNA, 23 bp, Artificial Sequence
  Synthetic Polynucleotide
cctcatcaccatccacgacygaa

SEQ ID NO: 892 - DNA, 23 bp, Artificial Sequence
  Synthetic Polynucleotide
cccaattatacagaaatcygaca

SEQ ID NO: 893 - DNA, 23 bp, Artificial Sequence
  Synthetic Polynucleotide
ccaattatacagaaatcygacag

SEQ ID NO: 894 - DNA, 23 bp, Artificial Sequence
  Synthetic Polynucleotide
ccccagttcctcttaccyggaag

SEQ ID NO: 895 - DNA, 23 bp, Artificial Sequence
  Synthetic Polynucleotide
cccagttcctcttaccyggaagc

SEQ ID NO: 896 - DNA, 23 bp, Artificial Sequence
  Synthetic Polynucleotide
ccagttcctcttaccyggaagct

SEQ ID NO: 897 - DNA, 23 bp, Artificial Sequence
  Synthetic Polynucleotide
ccactccagttgctgyccccttt

SEQ ID NO: 898 - DNA, 23 bp, Artificial Sequence
  Synthetic Polynucleotide
ccttagtgatattgacyagagtt

SEQ ID NO: 899 - DNA, 23 bp, Artificial Sequence
  Synthetic Polynucleotide
cccttcccatgacaaataygtac

SEQ ID NO: 900 - DNA, 23 bp, Artificial Sequence
  Synthetic Polynucleotide
ccttcccatgacaaataygtacc

SEQ ID NO: 901 - DNA, 23 bp, Artificial Sequence
  Synthetic Polynucleotide
ccgcctcctccagctgcttyagg

SEQ ID NO: 902 - DNA, 23 bp, Artificial Sequence
  Synthetic Polynucleotide
cctcctccagctgcttyaggcta

SEQ ID NO: 903 - DNA, 23 bp, Artificial Sequence
  Synthetic Polynucleotide
ccatgtttttttccttgygactc

SEQ ID NO: 904 - DNA, 23 bp, Artificial Sequence
  Synthetic Polynucleotide
ccattggacacagaatcygagtg

SEQ ID NO: 905 - DNA, 23 bp, Artificial Sequence
  Synthetic Polynucleotide
ccagatgctggatgtgctgyagg

SEQ ID NO: 906 - DNA, 23 bp, Artificial Sequence
  Synthetic Polynucleotide
ccaaggacaagtttyggagaatg

SEQ ID NO: 907 - DNA, 23 bp, Artificial Sequence
  Synthetic Polynucleotide
cccgttttcttcttgtttaygag

SEQ ID NO: 908 - DNA, 23 bp, Artificial Sequence
  Synthetic Polynucleotide
ccgttttcttcttgtttaygaga

SEQ ID NO: 909 - DNA, 23 bp, Artificial Sequence
  Synthetic Polynucleotide
cccacctggcttcagaacaytca

SEQ ID NO: 910 - DNA, 23 bp, Artificial Sequence
  Synthetic Polynucleotide
ccacctggcttcagaacaytcat

SEQ ID NO: 911 - DNA, 23 bp, Artificial Sequence
  Synthetic Polynucleotide
cctggcttcagaacaytcatgtc

SEQ ID NO: 912 - DNA, 23 bp, Artificial Sequence
  Synthetic Polynucleotide
ccgcacgctgctctttgytttga

SEQ ID NO: 913 - DNA, 23 bp, Artificial Sequence
  Synthetic Polynucleotide
ccagaatactgaataccaayaac

SEQ ID NO: 914 - DNA, 23 bp, Artificial Sequence
  Synthetic Polynucleotide
cccacaccagctgcatttthagc

SEQ ID NO: 915 - DNA, 23 bp, Artificial Sequence
  Synthetic Polynucleotide
ccacaccagctgcatttthagca

SEQ ID NO: 916 - DNA, 23 bp, Artificial Sequence
  Synthetic Polynucleotide
ccccaaaaatctcagcygacttt

SEQ ID NO: 917 - DNA, 23 bp, Artificial Sequence
  Synthetic Polynucleotide
cccaaaaatctcagcygactttt

SEQ ID NO: 918 - DNA, 23 bp, Artificial Sequence
  Synthetic Polynucleotide
ccaaaaatctcagcygacttttc

SEQ ID NO: 919 - DNA, 23 bp, Artificial Sequence
  Synthetic Polynucleotide
cccgccgtttttgttyagtctac

SEQ ID NO: 920 - DNA, 23 bp, Artificial Sequence
  Synthetic Polynucleotide
ccgccgtttttgttyagtctacc

SEQ ID NO: 921 - DNA, 23 bp, Artificial Sequence
  Synthetic Polynucleotide
ccaagtgaaatttagaagaygac

SEQ ID NO: 922 - DNA, 23 bp, Artificial Sequence
  Synthetic Polynucleotide
ccttgaggaattctcytggtgaa

SEQ ID NO: 923 - DNA, 23 bp, Artificial Sequence
  Synthetic Polynucleotide
ccatttggctttgggcccygtgg

SEQ ID NO: 924 - DNA, 23 bp, Artificial Sequence
  Synthetic Polynucleotide
cccatggaagcagaggygcagtg

SEQ ID NO: 925 - DNA, 23 bp, Artificial Sequence
  Synthetic Polynucleotide
ccatggaagcagaggygcagtgc

SEQ ID NO: 926 - DNA, 23 bp, Artificial Sequence
  Synthetic Polynucleotide
ccctttggtagatgaycccgcat

SEQ ID NO: 927 - DNA, 23 bp, Artificial Sequence
  Synthetic Polynucleotide
cctttggtagatgaycccgcatg

SEQ ID NO: 928 - DNA, 23 bp, Artificial Sequence
  Synthetic Polynucleotide
cctgggccatggccggaygctgt

SEQ ID NO: 929 - DNA, 23 bp, Artificial Sequence
  Synthetic Polynucleotide
ccgtaccgagaagccycaagagg

SEQ ID NO: 930 - DNA, 23 bp, Artificial Sequence
  Synthetic Polynucleotide
ccagccatccacctcayagatcg

SEQ ID NO: 931 - DNA, 23 bp, Artificial Sequence
  Synthetic Polynucleotide
ccccgaagacagagctgyagtcg

SEQ ID NO: 932 - DNA, 23 bp, Artificial Sequence
  Synthetic Polynucleotide
cccgaagacagagctgyagtcgg

SEQ ID NO: 933 - DNA, 23 bp, Artificial Sequence
  Synthetic Polynucleotide
ccgaagacagagctgyagtcggg

SEQ ID NO: 934 - DNA, 23 bp, Artificial Sequence
  Synthetic Polynucleotide
ccatcttcgtctgggcttyggga

SEQ ID NO: 935 - DNA, 23 bp, Artificial Sequence
  Synthetic Polynucleotide
ccctgttgccaatgtctygctga

SEQ ID NO: 936 - DNA, 23 bp, Artificial Sequence
  Synthetic Polynucleotide
cctgttgccaatgtctygctgac

SEQ ID NO: 937 - DNA, 23 bp, Artificial Sequence
  Synthetic Polynucleotide
cctccacaggttaacatcygaaa

SEQ ID NO: 938 - DNA, 23 bp, Artificial Sequence
  Synthetic Polynucleotide
ccacaggttaacatcygaaaaag

SEQ ID NO: 939 - DNA, 23 bp, Artificial Sequence
  Synthetic Polynucleotide
cccggccatgcttgyggacatgc

SEQ ID NO: 940 - DNA, 23 bp, Artificial Sequence
  Synthetic Polynucleotide
ccaggctcggcatttctggyagc

SEQ ID NO: 941 - DNA, 23 bp, Artificial Sequence
  Synthetic Polynucleotide
cccactgcctggtcaagyagcta

SEQ ID NO: 942 - DNA, 23 bp, Artificial Sequence
  Synthetic Polynucleotide
ccactgcctggtcaagyagctac

SEQ ID NO: 943 - DNA, 23 bp, Artificial Sequence
  Synthetic Polynucleotide
ccacgacaggctggtacygcatg

SEQ ID NO: 944 - DNA, 23 bp, Artificial Sequence
  Synthetic Polynucleotide
ccgccgatttgccaacygagtcc

SEQ ID NO: 945 - DNA, 23 bp, Artificial Sequence
  Synthetic Polynucleotide
ccgcctttcactgtatcagygag

SEQ ID NO: 946 - DNA, 23 bp, Artificial Sequence
  Synthetic Polynucleotide
cctttcactgtatcagygagccg

SEQ ID NO: 947 - DNA, 23 bp, Artificial Sequence
  Synthetic Polynucleotide
ccaggtcagtagtgcttcyggtg

SEQ ID NO: 948 - DNA, 23 bp, Artificial Sequence
  Synthetic Polynucleotide
ccaggaaggctgcctygtcctct

SEQ ID NO: 949 - DNA, 23 bp, Artificial Sequence
  Synthetic Polynucleotide
ccttatcatgaatggccygccga

SEQ ID NO: 950 - DNA, 23 bp, Artificial Sequence
  Synthetic Polynucleotide
gggargaccatgggtaaggaggg

SEQ ID NO: 951 - DNA, 23 bp, Artificial Sequence
  Synthetic Polynucleotide
tgggargaccatgggtaaggagg

SEQ ID NO: 952 - DNA, 23 bp, Artificial Sequence
  Synthetic Polynucleotide
ccatgggargaccatgggtaagg

SEQ ID NO: 953 - DNA, 23 bp, Artificial Sequence
  Synthetic Polynucleotide
ccccgactacagcatcytctcct

SEQ ID NO: 954 - DNA, 23 bp, Artificial Sequence
  Synthetic Polynucleotide
cccgactacagcatcytctcctt

SEQ ID NO: 955 - DNA, 23 bp, Artificial Sequence
  Synthetic Polynucleotide
ccgactacagcatcytctccttc

SEQ ID NO: 956 - DNA, 23 bp, Artificial Sequence
  Synthetic Polynucleotide
cctgggccacaatggagygggga

SEQ ID NO: 957 - DNA, 23 bp, Artificial Sequence
  Synthetic Polynucleotide
atgttctcrccgaagtatatggg

SEQ ID NO: 958 - DNA, 23 bp, Artificial Sequence
  Synthetic Polynucleotide
ctgrctctctgctctgctgtggg

SEQ ID NO: 959 - DNA, 23 bp, Artificial Sequence
  Synthetic Polynucleotide
tctgrctctctgctctgctgtgg

SEQ ID NO: 960 - DNA, 23 bp, Artificial Sequence
  Synthetic Polynucleotide
gtcccagraggaggcccagctgg

SEQ ID NO: 961 - DNA, 23 bp, Artificial Sequence
  Synthetic Polynucleotide
ggacraggccgacctccttgggg

SEQ ID NO: 962 - DNA, 23 bp, Artificial Sequence
  Synthetic Polynucleotide
tggacraggccgacctccttggg

SEQ ID NO: 963 - DNA, 23 bp, Artificial Sequence
  Synthetic Polynucleotide
atggacraggccgacctccttgg

SEQ ID NO: 964 - DNA, 23 bp, Artificial Sequence
  Synthetic Polynucleotide
tgtcgragttcgccctggagagg

SEQ ID NO: 965 - DNA, 23 bp, Artificial Sequence
  Synthetic Polynucleotide
cccagctgttccagaagyagaaa

SEQ ID NO: 966 - DNA, 23 bp, Artificial Sequence
  Synthetic Polynucleotide
ccagctgttccagaagyagaaat

SEQ ID NO: 967 - DNA, 23 bp, Artificial Sequence
  Synthetic Polynucleotide
ccatcggccgagtatgyaggact

SEQ ID NO: 968 - DNA, 23 bp, Artificial Sequence
  Synthetic Polynucleotide
cctgattcacctgcagcaygaag

SEQ ID NO: 969 - DNA, 23 bp, Artificial Sequence
  Synthetic Polynucleotide
cccacagatcgtgctccyggcta

SEQ ID NO: 970 - DNA, 23 bp, Artificial Sequence
  Synthetic Polynucleotide
ccacagatcgtgctccyggctac

SEQ ID NO: 971 - DNA, 23 bp, Artificial Sequence
  Synthetic Polynucleotide
cctagtgctttggcytcctggga

SEQ ID NO: 972 - DNA, 23 bp, Artificial Sequence
  Synthetic Polynucleotide
gggatttcrgatgagggctctgg

SEQ ID NO: 973 - DNA, 23 bp, Artificial Sequence
  Synthetic Polynucleotide
ccttctggtatggatycactcta

SEQ ID NO: 974 - DNA, 23 bp, Artificial Sequence
  Synthetic Polynucleotide
cctatgccggttgttttygattt

SEQ ID NO: 975 - DNA, 23 bp, Artificial Sequence
  Synthetic Polynucleotide
cctttcatcgagacgttayccca

SEQ ID NO: 976 - DNA, 23 bp, Artificial Sequence
  Synthetic Polynucleotide
ggcrtctggactctgtcaccagg

SEQ ID NO: 977 - DNA, 23 bp, Artificial Sequence
  Synthetic Polynucleotide
gagrgtgggatctggatcgacgg

SEQ ID NO: 978 - DNA, 23 bp, Artificial Sequence
  Synthetic Polynucleotide
ccagggcagcacagtggtcyggg

SEQ ID NO: 979 - DNA, 23 bp, Artificial Sequence
  Synthetic Polynucleotide
ccagaggatcagtttcccgygac

SEQ ID NO: 980 - DNA, 23 bp, Artificial Sequence
  Synthetic Polynucleotide
cccacatggctgagaygttccag

SEQ ID NO: 981 - DNA, 23 bp, Artificial Sequence
  Synthetic Polynucleotide
ccacatggctgagaygttccagg

SEQ ID NO: 982 - DNA, 23 bp, Artificial Sequence
  Synthetic Polynucleotide
cctggccagtgggctgctgyggc

SEQ ID NO: 983 - DNA, 23 bp, Artificial Sequence
  Synthetic Polynucleotide
ccagtgggctgctgyggctccag

SEQ ID NO: 984 - DNA, 23 bp, Artificial Sequence
  Synthetic Polynucleotide
cctcttcagcggcaccatcyggt

SEQ ID NO: 985 - DNA, 23 bp, Artificial Sequence
  Synthetic Polynucleotide
ccactttggtgatgaycaacaag

SEQ ID NO: 986 - DNA, 23 bp, Artificial Sequence
  Synthetic Polynucleotide
ccttggaatctctaactygctca

SEQ ID NO: 987 - DNA, 23 bp, Artificial Sequence
  Synthetic Polynucleotide
tggcccrcatgttctaccacagg

SEQ ID NO: 988 - DNA, 23 bp, Artificial Sequence
  Synthetic Polynucleotide
ggtggcragaagcagagaatcgg

SEQ ID NO: 989 - DNA, 23 bp, Artificial Sequence
  Synthetic Polynucleotide
tcgraggagatcgccttctatgg

SEQ ID NO: 990 - DNA, 23 bp, Artificial Sequence
  Synthetic Polynucleotide
gttcrgggagctggtggcagagg

SEQ ID NO: 991 - DNA, 23 bp, Artificial Sequence
  Synthetic Polynucleotide
tccrgatcctgggtgggctctgg

SEQ ID NO: 992 - DNA, 23 bp, Artificial Sequence
  Synthetic Polynucleotide
gactrgaaggacgtcctgtcggg

SEQ ID NO: 993 - DNA, 23 bp, Artificial Sequence
  Synthetic Polynucleotide
tgactrgaaggacgtcctgtcgg

SEQ ID NO: 994 - DNA, 23 bp, Artificial Sequence
  Synthetic Polynucleotide
ccaggtgatctaccyggactcag

SEQ ID NO: 995 - DNA, 23 bp, Artificial Sequence
  Synthetic Polynucleotide
cctgcaccacatcctgcagyggg

SEQ ID NO: 996 - DNA, 23 bp, Artificial Sequence
  Synthetic Polynucleotide
ccaaggcatcctcataycacatc

SEQ ID NO: 997 - DNA, 23 bp, Artificial Sequence
  Synthetic Polynucleotide
caagtggragatggaacgcacgg

SEQ ID NO: 998 - DNA, 23 bp, Artificial Sequence
  Synthetic Polynucleotide
cccccgttctatatcatcaytga

SEQ ID NO: 999 - DNA, 23 bp, Artificial Sequence
  Synthetic Polynucleotide
ccccgttctatatcatcaytgag

SEQ ID NO: 1000 - DNA, 23 bp, Artificial Sequence
  Synthetic Polynucleotide
cccgttctatatcatcaytgagt

SEQ ID NO: 1001 - DNA, 23 bp, Artificial Sequence
  Synthetic Polynucleotide
ccgttctatatcatcaytgagtt

SEQ ID NO: 1002 - DNA, 23 bp, Artificial Sequence
  Synthetic Polynucleotide
ccgtacgagcgcatactgygtga

SEQ ID NO: 1003 - DNA, 23 bp, Artificial Sequence
  Synthetic Polynucleotide
ccaacrgaggaaaagctaattgg

SEQ ID NO: 1004 - DNA, 23 bp, Artificial Sequence
  Synthetic Polynucleotide
tcagrgcatcagtgccttcctgg

SEQ ID NO: 1005 - DNA, 23 bp, Artificial Sequence
  Synthetic Polynucleotide
agccgtgrctgcgcctccaccgg

SEQ ID NO: 1006 - DNA, 23 bp, Artificial Sequence
  Synthetic Polynucleotide
ccggcagagcggcactacygcga

SEQ ID NO: 1007 - DNA, 23 bp, Artificial Sequence
  Synthetic Polynucleotide
ccaatgcctgggaggyttcggct

SEQ ID NO: 1008 - DNA, 23 bp, Artificial Sequence
  Synthetic Polynucleotide
ccaagctggccgcctyggaggcc

SEQ ID NO: 1009 - DNA, 23 bp, Artificial Sequence
  Synthetic Polynucleotide
cctggccctggagagtgccyggc

SEQ ID NO: 1010 - DNA, 23 bp, Artificial Sequence
  Synthetic Polynucleotide
ccctggagagtgccyggctgctg

SEQ ID NO: 1011 - DNA, 23 bp, Artificial Sequence
  Synthetic Polynucleotide
ccatggaggagatcagcygtggc

SEQ ID NO: 1012 - DNA, 23 bp, Artificial Sequence
  Synthetic Polynucleotide
ccgagaaggagttgtttcycatt

SEQ ID NO: 1013 - DNA, 23 bp, Artificial Sequence
  Synthetic Polynucleotide
atcragtggatggggggagtagg

SEQ ID NO: 1014 - DNA, 23 bp, Artificial Sequence
  Synthetic Polynucleotide
cctgaaaacaaattggggytcag

SEQ ID NO: 1015 - DNA, 23 bp, Artificial Sequence
  Synthetic Polynucleotide
gggggrtatgggcttcatgaagg

SEQ ID NO: 1016 - DNA, 23 bp, Artificial Sequence
  Synthetic Polynucleotide
tatggrcttcatgaaggtacagg

SEQ ID NO: 1017 - DNA, 23 bp, Artificial Sequence
  Synthetic Polynucleotide
ccgagatcttcgcatcttcygga

SEQ ID NO: 1018 - DNA, 23 bp, Artificial Sequence
  Synthetic Polynucleotide
ccccaggctgcagctyggatccg

SEQ ID NO: 1019 - DNA, 23 bp, Artificial Sequence
  Synthetic Polynucleotide
cccaggctgcagctyggatccga

SEQ ID NO: 1020 - DNA, 23 bp, Artificial Sequence
  Synthetic Polynucleotide
gaacracaggaccatcgaagggg

SEQ ID NO: 1021 - DNA, 23 bp, Artificial Sequence
  Synthetic Polynucleotide
tgaacracaggaccatcgaaggg

SEQ ID NO: 1022 - DNA, 23 bp, Artificial Sequence
  Synthetic Polynucleotide
ctgaacracaggaccatcgaagg

SEQ ID NO: 1023 - DNA, 23 bp, Artificial Sequence
  Synthetic Polynucleotide
aggactgtrtggtgatgatctgg

SEQ ID NO: 1024 - DNA, 23 bp, Artificial Sequence
  Synthetic Polynucleotide
ccgcagtacaactggacgcygaa

SEQ ID NO: 1025 - DNA, 23 bp, Artificial Sequence
  Synthetic Polynucleotide
ccttaggaactcaccttygaggc

SEQ ID NO: 1026 - DNA, 23 bp, Artificial Sequence
  Synthetic Polynucleotide
gtcatgratgagtggcggtgtgg

SEQ ID NO: 1027 - DNA, 23 bp, Artificial Sequence
  Synthetic Polynucleotide
ccagtactggatccgaggcygga

SEQ ID NO: 1028 - DNA, 23 bp, Artificial Sequence
  Synthetic Polynucleotide
cctccacgtgctccygctgcacc

SEQ ID NO: 1029 - DNA, 23 bp, Artificial Sequence
  Synthetic Polynucleotide
ctacragctgccagacgggcagg

SEQ ID NO: 1030 - DNA, 23 bp, Artificial Sequence
  Synthetic Polynucleotide
agagctacragctgccagacggg

SEQ ID NO: 1031 - DNA, 23 bp, Artificial Sequence
  Synthetic Polynucleotide
cctgaagtaccctatcgagyacg

SEQ ID NO: 1032 - DNA, 23 bp, Artificial Sequence
  Synthetic Polynucleotide
gacrtcccagacatcaggtgagg

SEQ ID NO: 1033 - DNA, 23 bp, Artificial Sequence
  Synthetic Polynucleotide
tgtgggacrtcccagacatcagg

SEQ ID NO: 1034 - DNA, 23 bp, Artificial Sequence
  Synthetic Polynucleotide
atcatgcrtctggatctggctgg

SEQ ID NO: 1035 - DNA, 23 bp, Artificial Sequence
  Synthetic Polynucleotide
cccatccattgtgggabgtccca

SEQ ID NO: 1036 - DNA, 23 bp, Artificial Sequence
  Synthetic Polynucleotide
ccatccattgtgggabgtcccag

SEQ ID NO: 1037 - DNA, 23 bp, Artificial Sequence
  Synthetic Polynucleotide
caaccgcragaagatgacccagg

SEQ ID NO: 1038 - DNA, 23 bp, Artificial Sequence
  Synthetic Polynucleotide
gcacrgcatcgtcaccaactggg

SEQ ID NO: 1039 - DNA, 23 bp, Artificial Sequence
  Synthetic Polynucleotide
agcacrgcatcgtcaccaactgg

SEQ ID NO: 1040 - DNA, 23 bp, Artificial Sequence
  Synthetic Polynucleotide
cctcaccctgaagtaccycatcg

SEQ ID NO: 1041 - DNA, 23 bp, Artificial Sequence
  Synthetic Polynucleotide
ccaaccgcgagaagatgayccag

SEQ ID NO: 1042 - DNA, 23 bp, Artificial Sequence
  Synthetic Polynucleotide
ccgcgagaagatgayccaggtga

SEQ ID NO: 1043 - DNA, 23 bp, Artificial Sequence
  Synthetic Polynucleotide
cctctggccgtaccaytggcatc

SEQ ID NO: 1044 - DNA, 23 bp, Artificial Sequence
  Synthetic Polynucleotide
ccggaggcgctgttccagcyttc

SEQ ID NO: 1045 - DNA, 23 bp, Artificial Sequence
  Synthetic Polynucleotide
ccaacagagagaagatgaytcag

SEQ ID NO: 1046 - DNA, 23 bp, Artificial Sequence
  Synthetic Polynucleotide
ccccggccatgtacgtggycatc

SEQ ID NO: 1047 - DNA, 23 bp, Artificial Sequence
  Synthetic Polynucleotide
cccggccatgtacgtggycatcc

SEQ ID NO: 1048 - DNA, 23 bp, Artificial Sequence
  Synthetic Polynucleotide
ccggccatgtacgtggycatcca

SEQ ID NO: 1049 - DNA, 23 bp, Artificial Sequence
  Synthetic Polynucleotide
cctgccccatgccatcatgygcc

SEQ ID NO: 1050 - DNA, 23 bp, Artificial Sequence
  Synthetic Polynucleotide
ccccatgccatcatgygcctgga

SEQ ID NO: 1051 - DNA, 23 bp, Artificial Sequence
  Synthetic Polynucleotide
cccatgccatcatgygcctggac

SEQ ID NO: 1052 - DNA, 23 bp, Artificial Sequence
  Synthetic Polynucleotide
ccattgtgggccgccctygccac

SEQ ID NO: 1053 - DNA, 23 bp, Artificial Sequence
  Synthetic Polynucleotide
ggcrtcaaactggtgtccatcgg

SEQ ID NO: 1054 - DNA, 23 bp, Artificial Sequence
  Synthetic Polynucleotide
ccarccatacatcctggcggagg

SEQ ID NO: 1055 - DNA, 23 bp, Artificial Sequence
  Synthetic Polynucleotide
ttcccarccatacatcctggcgg

SEQ ID NO: 1056 - DNA, 23 bp, Artificial Sequence
  Synthetic Polynucleotide
ggcrctgaaggtgagaggtgtgg

SEQ ID NO: 1057 - DNA, 23 bp, Artificial Sequence
  Synthetic Polynucleotide
ccattggcrctgaaggtgagagg

SEQ ID NO: 1058 - DNA, 23 bp, Artificial Sequence
  Synthetic Polynucleotide
ctggagcrcaccaaccagagcgg

SEQ ID NO: 1059 - DNA, 23 bp, Artificial Sequence
  Synthetic Polynucleotide
aagrccgctatggcgaagtgtgg

SEQ ID NO: 1060 - DNA, 23 bp, Artificial Sequence
  Synthetic Polynucleotide
cagtrttgcatcgccgacctggg

SEQ ID NO: 1061 - DNA, 23 bp, Artificial Sequence
  Synthetic Polynucleotide
gcagtrttgcatcgccgacctgg

SEQ ID NO: 1062 - DNA, 23 bp, Artificial Sequence
  Synthetic Polynucleotide
cccgagagtgggcaccaagyggt

SEQ ID NO: 1063 - DNA, 23 bp, Artificial Sequence
  Synthetic Polynucleotide
ccgagagtgggcaccaagyggta

SEQ ID NO: 1064 - DNA, 23 bp, Artificial Sequence
  Synthetic Polynucleotide
cccgactcaccgcgctgyggatc

SEQ ID NO: 1065 - DNA, 23 bp, Artificial Sequence
  Synthetic Polynucleotide
ccgactcaccgcgctgyggatca

SEQ ID NO: 1066 - DNA, 23 bp, Artificial Sequence
  Synthetic Polynucleotide
tcaccrtactgtccacgccgggg

SEQ ID NO: 1067 - DNA, 23 bp, Artificial Sequence
  Synthetic Polynucleotide
ttcaccrtactgtccacgccggg

SEQ ID NO: 1068 - DNA, 23 bp, Artificial Sequence
  Synthetic Polynucleotide
attcaccrtactgtccacgccgg

SEQ ID NO: 1069 - DNA, 23 bp, Artificial Sequence
  Synthetic Polynucleotide
ccacgccrgggaggtgggctcgg

SEQ ID NO: 1070 - DNA, 23 bp, Artificial Sequence
  Synthetic Polynucleotide
cctttccagaacatcaatgyggc

SEQ ID NO: 1071 - DNA, 23 bp, Artificial Sequence
  Synthetic Polynucleotide
ccagaacatcaatgyggccaaat

SEQ ID NO: 1072 - DNA, 23 bp, Artificial Sequence
  Synthetic Polynucleotide
ccatcctgtgctgcatgygccac

SEQ ID NO: 1073 - DNA, 23 bp, Artificial Sequence
  Synthetic Polynucleotide
cccttcccaggggctgcygggag

SEQ ID NO: 1074 - DNA, 23 bp, Artificial Sequence
  Synthetic Polynucleotide
ccttcccaggggctgcygggagg

SEQ ID NO: 1075 - DNA, 23 bp, Artificial Sequence
  Synthetic Polynucleotide
ccgagcccacctccccggygtgg

SEQ ID NO: 1076 - DNA, 23 bp, Artificial Sequence
  Synthetic Polynucleotide
acgcacrccttccggtctcaagg

SEQ ID NO: 1077 - DNA, 23 bp, Artificial Sequence
  Synthetic Polynucleotide
cctgaagcgatcggtcagcygag

SEQ ID NO: 1078 - DNA, 23 bp, Artificial Sequence
  Synthetic Polynucleotide
gcctgagrtaggcatggagctgg

SEQ ID NO: 1079 - DNA, 23 bp, Artificial Sequence
  Synthetic Polynucleotide
ggtrtatgccaagtggcccccgg

SEQ ID NO: 1080 - DNA, 23 bp, Artificial Sequence
  Synthetic Polynucleotide
tgctcccrctcctgcggaggagg

SEQ ID NO: 1081 - DNA, 23 bp, Artificial Sequence
  Synthetic Polynucleotide
actrtgcagtggccattgggcgg

SEQ ID NO: 1082 - DNA, 23 bp, Artificial Sequence
  Synthetic Polynucleotide
cagactrtgcagtggccattggg

SEQ ID NO: 1083 - DNA, 23 bp, Artificial Sequence
  Synthetic Polynucleotide
gcagactrtgcagtggccattgg

SEQ ID NO: 1084 - DNA, 23 bp, Artificial Sequence
  Synthetic Polynucleotide
acarggggcagaactgcttcggg

SEQ ID NO: 1085 - DNA, 23 bp, Artificial Sequence
  Synthetic Polynucleotide
cacarggggcagaactgcttcgg

SEQ ID NO: 1086 - DNA, 23 bp, Artificial Sequence
  Synthetic Polynucleotide
ccactggggtgctgctgtaycac

SEQ ID NO: 1087 - DNA, 23 bp, Artificial Sequence
  Synthetic Polynucleotide
ccaggaggacacagagygctatg

SEQ ID NO: 1088 - DNA, 23 bp, Artificial Sequence
  Synthetic Polynucleotide
cccagcggacacgtgatggyttc

SEQ ID NO: 1089 - DNA, 23 bp, Artificial Sequence
  Synthetic Polynucleotide
ccagcggacacgtgatggyttcg

SEQ ID NO: 1090 - DNA, 23 bp, Artificial Sequence
  Synthetic Polynucleotide
ccacggggccgaggccgccyaga

SEQ ID NO: 1091 - DNA, 23 bp, Artificial Sequence
  Synthetic Polynucleotide
ggagtrggagtacagagacgagg

SEQ ID NO: 1092 - DNA, 23 bp, Artificial Sequence
  Synthetic Polynucleotide
ccctcctctcggggggccayagg

SEQ ID NO: 1093 - DNA, 23 bp, Artificial Sequence
  Synthetic Polynucleotide
cctcctctcggggggccayaggc

SEQ ID NO: 1094 - DNA, 23 bp, Artificial Sequence
  Synthetic Polynucleotide
cctctcggggggccayaggccct

SEQ ID NO: 1095 - DNA, 23 bp, Artificial Sequence
  Synthetic Polynucleotide
agcrgcactgcctgcagcagagg

SEQ ID NO: 1096 - DNA, 23 bp, Artificial Sequence
  Synthetic Polynucleotide
ccacatctccagcaaacygtgtg

SEQ ID NO: 1097 - DNA, 23 bp, Artificial Sequence
  Synthetic Polynucleotide
ccacgtgacgggcaactatygca

SEQ ID NO: 1098 - DNA, 23 bp, Artificial Sequence
  Synthetic Polynucleotide
ccagctgcgtactggaaaygagt

SEQ ID NO: 1099 - DNA, 23 bp, Artificial Sequence
  Synthetic Polynucleotide
ctacraggtcaaggtgagcaggg

SEQ ID NO: 1100 - DNA, 23 bp, Artificial Sequence
  Synthetic Polynucleotide
gctacraggtcaaggtgagcagg

SEQ ID NO: 1101 - DNA, 23 bp, Artificial Sequence
  Synthetic Polynucleotide
cctcaccrgctacgaggtcaagg

SEQ ID NO: 1102 - DNA, 23 bp, Artificial Sequence
  Synthetic Polynucleotide
cctgtgacgaggattggcyggct

SEQ ID NO: 1103 - DNA, 23 bp, Artificial Sequence
  Synthetic Polynucleotide
cctaagccaggacctgyggaacc

SEQ ID NO: 1104 - DNA, 23 bp, Artificial Sequence
  Synthetic Polynucleotide
cccctaccactttgtgtgcygag

SEQ ID NO: 1105 - DNA, 23 bp, Artificial Sequence
  Synthetic Polynucleotide
ccctaccactttgtgtgcygagg

SEQ ID NO: 1106 - DNA, 23 bp, Artificial Sequence
  Synthetic Polynucleotide
cctaccactttgtgtgcygaggc

SEQ ID NO: 1107 - DNA, 23 bp, Artificial Sequence
  Synthetic Polynucleotide
agccctcratgtcagcaaacagg

SEQ ID NO: 1108 - DNA, 23 bp, Artificial Sequence
  Synthetic Polynucleotide
ttgacrccaggagcattgatagg

SEQ ID NO: 1109 - DNA, 23 bp, Artificial Sequence
  Synthetic Polynucleotide
tcatctrgtactggtccatgcgg

SEQ ID NO: 1110 - DNA, 23 bp, Artificial Sequence
  Synthetic Polynucleotide
gccartaagtttggcacctgggg

SEQ ID NO: 1111 - DNA, 23 bp, Artificial Sequence
  Synthetic Polynucleotide
agccartaagtttggcacctggg

SEQ ID NO: 1112 - DNA, 23 bp, Artificial Sequence
  Synthetic Polynucleotide
cagccartaagtttggcacctgg

SEQ ID NO: 1113 - DNA, 23 bp, Artificial Sequence
  Synthetic Polynucleotide
cccgcaggtgctggatcygggac

SEQ ID NO: 1114 - DNA, 23 bp, Artificial Sequence
  Synthetic Polynucleotide
ccgcaggtgctggatcygggact

SEQ ID NO: 1115 - DNA, 23 bp, Artificial Sequence
  Synthetic Polynucleotide
ccccaggggcctctacyacttct

SEQ ID NO: 1116 - DNA, 23 bp, Artificial Sequence
  Synthetic Polynucleotide
cccaggggcctctacyacttctg

SEQ ID NO: 1117 - DNA, 23 bp, Artificial Sequence
  Synthetic Polynucleotide
ccaggggcctctacyacttctgc

SEQ ID NO: 1118 - DNA, 23 bp, Artificial Sequence
  Synthetic Polynucleotide
cccctggggaaaccattyaaacc

SEQ ID NO: 1119 - DNA, 23 bp, Artificial Sequence
  Synthetic Polynucleotide
ccctggggaaaccattyaaacct

SEQ ID NO: 1120 - DNA, 23 bp, Artificial Sequence
  Synthetic Polynucleotide
cctggggaaaccattyaaacctt

SEQ ID NO: 1121 - DNA, 23 bp, Artificial Sequence
  Synthetic Polynucleotide
tccragatgacctgcgcttccgg

SEQ ID NO: 1122 - DNA, 23 bp, Artificial Sequence
  Synthetic Polynucleotide
cccttgtcatggaccygctacag

SEQ ID NO: 1123 - DNA, 23 bp, Artificial Sequence
  Synthetic Polynucleotide
ccttgtcatggaccygctacaga

SEQ ID NO: 1124 - DNA, 23 bp, Artificial Sequence
  Synthetic Polynucleotide
ccagaacttgaagcgtgtcygag

SEQ ID NO: 1125 - DNA, 23 bp, Artificial Sequence
  Synthetic Polynucleotide
ccagagtgatctctyggcttgcc

SEQ ID NO: 1126 - DNA, 23 bp, Artificial Sequence
  Synthetic Polynucleotide
cccactgcctatgtgyggcccat

SEQ ID NO: 1127 - DNA, 23 bp, Artificial Sequence
  Synthetic Polynucleotide
ccactgcctatgtgyggcccatg

SEQ ID NO: 1128 - DNA, 23 bp, Artificial Sequence
  Synthetic Polynucleotide
aggatrtgtatgactttaggtgg

SEQ ID NO: 1129 - DNA, 23 bp, Artificial Sequence
  Synthetic Polynucleotide
gataggatrtgtatgactttagg

SEQ ID NO: 1130 - DNA, 23 bp, Artificial Sequence
  Synthetic Polynucleotide
ccctggagttcagtaytgtagga

SEQ ID NO: 1131 - DNA, 23 bp, Artificial Sequence
  Synthetic Polynucleotide
cctggagttcagtaytgtaggag

SEQ ID NO: 1132 - DNA, 23 bp, Artificial Sequence
  Synthetic Polynucleotide
tctccccrgtaggagcctcccgg

SEQ ID NO: 1133 - DNA, 23 bp, Artificial Sequence
  Synthetic Polynucleotide
ctcggracactgtgccctggagg

SEQ ID NO: 1134 - DNA, 23 bp, Artificial Sequence
  Synthetic Polynucleotide
tggctcggracactgtgccctgg

SEQ ID NO: 1135 - DNA, 23 bp, Artificial Sequence
  Synthetic Polynucleotide
gccrgggggctgcagatgatcgg

SEQ ID NO: 1136 - DNA, 23 bp, Artificial Sequence
  Synthetic Polynucleotide
aagtgrctggccaacttctgggg

SEQ ID NO: 1137 - DNA, 23 bp, Artificial Sequence
  Synthetic Polynucleotide
caagtgrctggccaacttctggg

SEQ ID NO: 1138 - DNA, 23 bp, Artificial Sequence
  Synthetic Polynucleotide
tcaagtgrctggccaacttctgg

SEQ ID NO: 1139 - DNA, 23 bp, Artificial Sequence
  Synthetic Polynucleotide
acccacrgggagtcgtccaccgg

SEQ ID NO: 1140 - DNA, 23 bp, Artificial Sequence
  Synthetic Polynucleotide
gtgctgcrgatcggcctgctggg

SEQ ID NO: 1141 - DNA, 23 bp, Artificial Sequence
  Synthetic Polynucleotide
ggtgctgcrgatcggcctgctgg

SEQ ID NO: 1142 - DNA, 23 bp, Artificial Sequence
  Synthetic Polynucleotide
ctcrcatcatggcagccgggggg

SEQ ID NO: 1143 - DNA, 23 bp, Artificial Sequence
  Synthetic Polynucleotide
cctcrcatcatggcagccggggg

SEQ ID NO: 1144 - DNA, 23 bp, Artificial Sequence
  Synthetic Polynucleotide
tcctcrcatcatggcagccgggg

SEQ ID NO: 1145 - DNA, 23 bp, Artificial Sequence
  Synthetic Polynucleotide
ctcctcrcatcatggcagccggg

SEQ ID NO: 1146 - DNA, 23 bp, Artificial Sequence
  Synthetic Polynucleotide
cctcctcrcatcatggcagccgg

SEQ ID NO: 1147 - DNA, 23 bp, Artificial Sequence
  Synthetic Polynucleotide
caatrccacccgcgagaatgtgg

SEQ ID NO: 1148 - DNA, 23 bp, Artificial Sequence
  Synthetic Polynucleotide
ccggggrgctgcagatgatcggg

SEQ ID NO: 1149 - DNA, 23 bp, Artificial Sequence
  Synthetic Polynucleotide
gccggggrgctgcagatgatcgg

SEQ ID NO: 1150 - DNA, 23 bp, Artificial Sequence
  Synthetic Polynucleotide
gcaratcatggacgagatcaagg

SEQ ID NO: 1151 - DNA, 23 bp, Artificial Sequence
  Synthetic Polynucleotide
ttgrggccaatggcatttggggg

SEQ ID NO: 1152 - DNA, 23 bp, Artificial Sequence
  Synthetic Polynucleotide
gttgrggccaatggcatttgggg

SEQ ID NO: 1153 - DNA, 23 bp, Artificial Sequence
  Synthetic Polynucleotide
ggttgrggccaatggcatttggg

SEQ ID NO: 1154 - DNA, 23 bp, Artificial Sequence
  Synthetic Polynucleotide
tggttgrggccaatggcatttgg

SEQ ID NO: 1155 - DNA, 23 bp, Artificial Sequence
  Synthetic Polynucleotide
catttrggggcagcgagccgtgg

SEQ ID NO: 1156 - DNA, 23 bp, Artificial Sequence
  Synthetic Polynucleotide
aactctrccacaggtgagcctgg

SEQ ID NO: 1157 - DNA, 23 bp, Artificial Sequence
  Synthetic Polynucleotide
gtacaagtrcctgctcctggtgg

SEQ ID NO: 1158 - DNA, 23 bp, Artificial Sequence
  Synthetic Polynucleotide
gtgrattcggtggcatccctggg

SEQ ID NO: 1159 - DNA, 23 bp, Artificial Sequence
  Synthetic Polynucleotide
ggtgrattcggtggcatccctgg

SEQ ID NO: 1160 - DNA, 23 bp, Artificial Sequence
  Synthetic Polynucleotide
cagctggcrccagcaccgcgagg

SEQ ID NO: 1161 - DNA, 23 bp, Artificial Sequence
  Synthetic Polynucleotide
cctgcacccaggagccygagtgc

SEQ ID NO: 1162 - DNA, 23 bp, Artificial Sequence
  Synthetic Polynucleotide
cctggccctcattgcggaayagg

SEQ ID NO: 1163 - DNA, 23 bp, Artificial Sequence
  Synthetic Polynucleotide
ccctcattgcggaayaggtgcat

SEQ ID NO: 1164 - DNA, 23 bp, Artificial Sequence
  Synthetic Polynucleotide
cctgcaggcactggggctgyagc

SEQ ID NO: 1165 - DNA, 23 bp, Artificial Sequence
  Synthetic Polynucleotide
tcggactrggacctagaccctgg

SEQ ID NO: 1166 - DNA, 23 bp, Artificial Sequence
  Synthetic Polynucleotide
ccgctgggctaagggtyggcgtg

SEQ ID NO: 1167 - DNA, 23 bp, Artificial Sequence
  Synthetic Polynucleotide
gagccragagctgcaggccctgg

SEQ ID NO: 1168 - DNA, 23 bp, Artificial Sequence
  Synthetic Polynucleotide
ccgggaggacgggatcyaaaaac

SEQ ID NO: 1169 - DNA, 23 bp, Artificial Sequence
  Synthetic Polynucleotide
ccatcgtgtgcaccatgygagaa

SEQ ID NO: 1170 - DNA, 23 bp, Artificial Sequence
  Synthetic Polynucleotide
gtgraatgaggccgaggccaagg

SEQ ID NO: 1171 - DNA, 23 bp, Artificial Sequence
  Synthetic Polynucleotide
gacgrgggtggctctgtggctgg

SEQ ID NO: 1172 - DNA, 23 bp, Artificial Sequence
  Synthetic Polynucleotide
tggggacgrgggtggctctgtgg

SEQ ID NO: 1173 - DNA, 23 bp, Artificial Sequence
  Synthetic Polynucleotide
cccctgcagccccgcgcacytgg

SEQ ID NO: 1174 - DNA, 23 bp, Artificial Sequence
  Synthetic Polynucleotide
ccctgcagccccgcgcacytggg

SEQ ID NO: 1175 - DNA, 23 bp, Artificial Sequence
  Synthetic Polynucleotide
cctgcagccccgcgcacytgggt

SEQ ID NO: 1176 - DNA, 23 bp, Artificial Sequence
  Synthetic Polynucleotide
tctccaccrgggacctcctgcgg

SEQ ID NO: 1177 - DNA, 23 bp, Artificial Sequence
  Synthetic Polynucleotide
gaagrggcagctggttccactgg

SEQ ID NO: 1178 - DNA, 23 bp, Artificial Sequence
  Synthetic Polynucleotide
ccctgagaccatgacccagyggc

SEQ ID NO: 1179 - DNA, 23 bp, Artificial Sequence
  Synthetic Polynucleotide
cctgagaccatgacccagyggct

SEQ ID NO: 1180 - DNA, 23 bp, Artificial Sequence
  Synthetic Polynucleotide
cccaaccctggagaggacaytca

SEQ ID NO: 1181 - DNA, 23 bp, Artificial Sequence
  Synthetic Polynucleotide
ccaaccctggagaggacaytcag

SEQ ID NO: 1182 - DNA, 23 bp, Artificial Sequence
  Synthetic Polynucleotide
ccctggagaggacaytcagggtc

SEQ ID NO: 1183 - DNA, 23 bp, Artificial Sequence
  Synthetic Polynucleotide
tagggragtacatcaagacctgg

SEQ ID NO: 1184 - DNA, 23 bp, Artificial Sequence
  Synthetic Polynucleotide
taccrcgacatcaaggttagtgg

SEQ ID NO: 1185 - DNA, 23 bp, Artificial Sequence
  Synthetic Polynucleotide
caggtraatacatcaagacctgg

SEQ ID NO: 1186 - DNA, 23 bp, Artificial Sequence
  Synthetic Polynucleotide
taggaraatatataaaaaactgg

SEQ ID NO: 1187 - DNA, 23 bp, Artificial Sequence
  Synthetic Polynucleotide
ctcgccrtgtaccacgtctctgg

SEQ ID NO: 1188 - DNA, 23 bp, Artificial Sequence
  Synthetic Polynucleotide
ctcrccgtgtaccacgtctctgg

SEQ ID NO: 1189 - DNA, 23 bp, Artificial Sequence
  Synthetic Polynucleotide
ggtrtgggtagaggggttgaagg

SEQ ID NO: 1190 - DNA, 23 bp, Artificial Sequence
  Synthetic Polynucleotide
ccctcatcccttaggacygggat

SEQ ID NO: 1191 - DNA, 23 bp, Artificial Sequence
  Synthetic Polynucleotide
cctcatcccttaggacygggatg

SEQ ID NO: 1192 - DNA, 23 bp, Artificial Sequence
  Synthetic Polynucleotide
atccaargtatccgtaacagtgg

SEQ ID NO: 1193 - DNA, 23 bp, Artificial Sequence
  Synthetic Polynucleotide
cgacrtggacaaggctgtggagg

SEQ ID NO: 1194 - DNA, 23 bp, Artificial Sequence
  Synthetic Polynucleotide
gcccgacrtggacaaggctgtgg

SEQ ID NO: 1195 - DNA, 23 bp, Artificial Sequence
  Synthetic Polynucleotide
ccagaggggctcgccatggygcc

SEQ ID NO: 1196 - DNA, 23 bp, Artificial Sequence
  Synthetic Polynucleotide
cccagtcacggagcggtyggcct

SEQ ID NO: 1197 - DNA, 23 bp, Artificial Sequence
  Synthetic Polynucleotide
ccagtcacggagcggtyggcctt

SEQ ID NO: 1198 - DNA, 23 bp, Artificial Sequence
  Synthetic Polynucleotide
gttagargagtgcttggactcgg

SEQ ID NO: 1199 - DNA, 23 bp, Artificial Sequence
  Synthetic Polynucleotide
cccggagtcgtccccaggaygtt

SEQ ID NO: 1200 - DNA, 23 bp, Artificial Sequence
  Synthetic Polynucleotide
ccggagtcgtccccaggaygttc

SEQ ID NO: 1201 - DNA, 23 bp, Artificial Sequence
  Synthetic Polynucleotide
aattcrgtgaatgtagtatttgg

SEQ ID NO: 1202 - DNA, 23 bp, Artificial Sequence
  Synthetic Polynucleotide
ccgagrcactgacatccgcatgg

SEQ ID NO: 1203 - DNA, 23 bp, Artificial Sequence
  Synthetic Polynucleotide
cctggcggaggtgggyatcacct

SEQ ID NO: 1204 - DNA, 23 bp, Artificial Sequence
  Synthetic Polynucleotide
gggrcctctgtcatgcatattgg

SEQ ID NO: 1205 - DNA, 23 bp, Artificial Sequence
  Synthetic Polynucleotide
cctcatcccccataccygataca

SEQ ID NO: 1206 - DNA, 23 bp, Artificial Sequence
  Synthetic Polynucleotide
cccacctgctggagacayacctc

SEQ ID NO: 1207 - DNA, 23 bp, Artificial Sequence
  Synthetic Polynucleotide
ccacctgctggagacayacctca

SEQ ID NO: 1208 - DNA, 23 bp, Artificial Sequence
  Synthetic Polynucleotide
ccttgggaatgaagcttygaggg

SEQ ID NO: 1209 - DNA, 23 bp, Artificial Sequence
  Synthetic Polynucleotide
acattgacrtgagtgctcggggg

SEQ ID NO: 1210 - DNA, 23 bp, Artificial Sequence
  Synthetic Polynucleotide
agacaacragatgccccctgagg

SEQ ID NO: 1211 - DNA, 23 bp, Artificial Sequence
  Synthetic Polynucleotide
aaggagrcagaattgaccacggg

SEQ ID NO: 1212 - DNA, 23 bp, Artificial Sequence
  Synthetic Polynucleotide
caaggagrcagaattgaccacgg

SEQ ID NO: 1213 - DNA, 23 bp, Artificial Sequence
  Synthetic Polynucleotide
cgccaccrcctacctgtgtgggg

SEQ ID NO: 1214 - DNA, 23 bp, Artificial Sequence
  Synthetic Polynucleotide
ccgccaccrcctacctgtgtggg

SEQ ID NO: 1215 - DNA, 23 bp, Artificial Sequence
  Synthetic Polynucleotide
cagcrccgcctacgcccactcgg

SEQ ID NO: 1216 - DNA, 23 bp, Artificial Sequence
  Synthetic Polynucleotide
ccaatgcccaggtccytgacagc

SEQ ID NO: 1217 - DNA, 23 bp, Artificial Sequence
  Synthetic Polynucleotide
cccacttcatctggaacygcacg

SEQ ID NO: 1218 - DNA, 23 bp, Artificial Sequence
  Synthetic Polynucleotide
ccacttcatctggaacygcacgg

SEQ ID NO: 1219 - DNA, 23 bp, Artificial Sequence
  Synthetic Polynucleotide
ccctgggcatcatccyaggtaat

SEQ ID NO: 1220 - DNA, 23 bp, Artificial Sequence
  Synthetic Polynucleotide
cctgggcatcatccyaggtaatg

SEQ ID NO: 1221 - DNA, 23 bp, Artificial Sequence
  Synthetic Polynucleotide
tccagrtaggagccaaaaagagg

SEQ ID NO: 1222 - DNA, 23 bp, Artificial Sequence
  Synthetic Polynucleotide
cctgatgtgtatgccygggagca

SEQ ID NO: 1223 - DNA, 23 bp, Artificial Sequence
  Synthetic Polynucleotide
cctcagcacatgtgyaacccaag

SEQ ID NO: 1224 - DNA, 23 bp, Artificial Sequence
  Synthetic Polynucleotide
gagccccrcctgtccatctatgg

SEQ ID NO: 1225 - DNA, 23 bp, Artificial Sequence
  Synthetic Polynucleotide
aggcagrcctctgcctgtatggg

SEQ ID NO: 1226 - DNA, 23 bp, Artificial Sequence
  Synthetic Polynucleotide
gaggcagrcctctgcctgtatgg

SEQ ID NO: 1227 - DNA, 23 bp, Artificial Sequence
  Synthetic Polynucleotide
ccgagccrggcaggtggaagtgg

SEQ ID NO: 1228 - DNA, 23 bp, Artificial Sequence
  Synthetic Polynucleotide
ccagctgggcgcctgcctygacc

SEQ ID NO: 1229 - DNA, 23 bp, Artificial Sequence
  Synthetic Polynucleotide
tcactgrcagacagtggcccagg

SEQ ID NO: 1230 - DNA, 23 bp, Artificial Sequence
  Synthetic Polynucleotide
ccgatgrtaccagtttcgagtgg

SEQ ID NO: 1231 - DNA, 23 bp, Artificial Sequence
  Synthetic Polynucleotide
ccgatggtaccagtttygagtgg

SEQ ID NO: 1232 - DNA, 23 bp, Artificial Sequence
  Synthetic Polynucleotide
cccttcacttcacatygacacat

SEQ ID NO: 1233 - DNA, 23 bp, Artificial Sequence
  Synthetic Polynucleotide
ccttcacttcacatygacacatg

SEQ ID NO: 1234 - DNA, 23 bp, Artificial Sequence
  Synthetic Polynucleotide
cccaggctaataggtctygagat

SEQ ID NO: 1235 - DNA, 23 bp, Artificial Sequence
  Synthetic Polynucleotide
ccaggctaataggtctygagatc

SEQ ID NO: 1236 - DNA, 23 bp, Artificial Sequence
  Synthetic Polynucleotide
cctaaaataaaatactaytcaca

SEQ ID NO: 1237 - DNA, 23 bp, Artificial Sequence
  Synthetic Polynucleotide
ccgggcaggcaagacgygcctgg

SEQ ID NO: 1238 - DNA, 23 bp, Artificial Sequence
  Synthetic Polynucleotide
ccaggtttatctaaagttgygat

SEQ ID NO: 1239 - DNA, 23 bp, Artificial Sequence
  Synthetic Polynucleotide
ccaggatatggaaaaaygagcac

SEQ ID NO: 1240 - DNA, 23 bp, Artificial Sequence
  Synthetic Polynucleotide
ccaaatccagcagactgyagggt

SEQ ID NO: 1241 - DNA, 23 bp, Artificial Sequence
  Synthetic Polynucleotide
ccaaccacattttggacagyagg

SEQ ID NO: 1242 - DNA, 23 bp, Artificial Sequence
  Synthetic Polynucleotide
ccacattttggacagyaggaatg

SEQ ID NO: 1243 - DNA, 23 bp, Artificial Sequence
  Synthetic Polynucleotide
acgccraggagctcaaggccagg

SEQ ID NO: 1244 - DNA, 23 bp, Artificial Sequence
  Synthetic Polynucleotide
cctagaagatacacgagacygaa

SEQ ID NO: 1245 - DNA, 23 bp, Artificial Sequence
  Synthetic Polynucleotide
tctgcccrtaagcacttggtggg

SEQ ID NO: 1246 - DNA, 23 bp, Artificial Sequence
  Synthetic Polynucleotide
ctctgcccrtaagcacttggtgg

SEQ ID NO: 1247 - DNA, 23 bp, Artificial Sequence
  Synthetic Polynucleotide
cagrcggcgcaggcccggctggg

SEQ ID NO: 1248 - DNA, 23 bp, Artificial Sequence
  Synthetic Polynucleotide
gcagrcggcgcaggcccggctgg

SEQ ID NO: 1249 - DNA, 23 bp, Artificial Sequence
  Synthetic Polynucleotide
agctgcagrcggcgcaggcccgg

SEQ ID NO: 1250 - DNA, 23 bp, Artificial Sequence
  Synthetic Polynucleotide
gcagcrccagtgggccgggctgg

SEQ ID NO: 1251 - DNA, 23 bp, Artificial Sequence
  Synthetic Polynucleotide
catgctcgrccagagcaccgagg

SEQ ID NO: 1252 - DNA, 23 bp, Artificial Sequence
  Synthetic Polynucleotide
ccgatgacctgcagaagygcctg

SEQ ID NO: 1253 - DNA, 23 bp, Artificial Sequence
  Synthetic Polynucleotide
cccacctgcgcaagctgygtaag

SEQ ID NO: 1254 - DNA, 23 bp, Artificial Sequence
  Synthetic Polynucleotide
ccacctgcgcaagctgygtaagc

SEQ ID NO: 1255 - DNA, 23 bp, Artificial Sequence
  Synthetic Polynucleotide
cctcgcctcccacctgygcaagc

SEQ ID NO: 1256 - DNA, 23 bp, Artificial Sequence
  Synthetic Polynucleotide
gaaratgtgggttcaaacaaagg

SEQ ID NO: 1257 - DNA, 23 bp, Artificial Sequence
  Synthetic Polynucleotide
gacartgatcgtcatcaccttgg

SEQ ID NO: 1258 - DNA, 23 bp, Artificial Sequence
  Synthetic Polynucleotide
tctgtgrgcctcctattccctgg

SEQ ID NO: 1259 - DNA, 23 bp, Artificial Sequence
  Synthetic Polynucleotide
ccattggctggtcttacygtgga

SEQ ID NO: 1260 - DNA, 23 bp, Artificial Sequence
  Synthetic Polynucleotide
ccctgggcttcaaataccyggtg

SEQ ID NO: 1261 - DNA, 23 bp, Artificial Sequence
  Synthetic Polynucleotide
cctgggcttcaaataccyggtgg

SEQ ID NO: 1262 - DNA, 23 bp, Artificial Sequence
  Synthetic Polynucleotide
ccatgaacccagccygctctttt

SEQ ID NO: 1263 - DNA, 23 bp, Artificial Sequence
  Synthetic Polynucleotide
atgraagtgcagttagggctggg

SEQ ID NO: 1264 - DNA, 23 bp, Artificial Sequence
  Synthetic Polynucleotide
gatgraagtgcagttagggctgg

SEQ ID NO: 1265 - DNA, 23 bp, Artificial Sequence
  Synthetic Polynucleotide
caaggatgraagtgcagttaggg

SEQ ID NO: 1266 - DNA, 23 bp, Artificial Sequence
  Synthetic Polynucleotide
aagtgrgccaaggccttgcctgg

SEQ ID NO: 1267 - DNA, 23 bp, Artificial Sequence
  Synthetic Polynucleotide
cttacacrtggacgaccagatgg

SEQ ID NO: 1268 - DNA, 23 bp, Artificial Sequence
  Synthetic Polynucleotide
ggtaccrcatgcacaagtcccgg

SEQ ID NO: 1269 - DNA, 23 bp, Artificial Sequence
  Synthetic Polynucleotide
ggccaagrccttgcctggtaagg

SEQ ID NO: 1270 - DNA, 23 bp, Artificial Sequence
  Synthetic Polynucleotide
ccagggaccatgttttgyccatt

SEQ ID NO: 1271 - DNA, 23 bp, Artificial Sequence
  Synthetic Polynucleotide
ccgcgaaggacggcaycaaggac

SEQ ID NO: 1272 - DNA, 23 bp, Artificial Sequence
  Synthetic Polynucleotide
ccagcccggcctgtacccayagc

SEQ ID NO: 1273 - DNA, 23 bp, Artificial Sequence
  Synthetic Polynucleotide
cccggcctgtacccayagcagcc

SEQ ID NO: 1274 - DNA, 23 bp, Artificial Sequence
  Synthetic Polynucleotide
ccggcctgtacccayagcagccg

SEQ ID NO: 1275 - DNA, 23 bp, Artificial Sequence
  Synthetic Polynucleotide
cccaacagcagcatgyaggacat

SEQ ID NO: 1276 - DNA, 23 bp, Artificial Sequence
  Synthetic Polynucleotide
ccaacagcagcatgyaggacatg

SEQ ID NO: 1277 - DNA, 23 bp, Artificial Sequence
  Synthetic Polynucleotide
cccctggacctgttcygactcta

SEQ ID NO: 1278 - DNA, 23 bp, Artificial Sequence
  Synthetic Polynucleotide
ccctggacctgttcygactctac

SEQ ID NO: 1279 - DNA, 23 bp, Artificial Sequence
  Synthetic Polynucleotide
ccctcctggaactcagcygaggc

SEQ ID NO: 1280 - DNA, 23 bp, Artificial Sequence
  Synthetic Polynucleotide
cctcctggaactcagcygaggct

SEQ ID NO: 1281 - DNA, 23 bp, Artificial Sequence
  Synthetic Polynucleotide
ttcaggccrcgggccatttgggg

SEQ ID NO: 1282 - DNA, 23 bp, Artificial Sequence
  Synthetic Polynucleotide
ggccrgcaagtggcaccttgggg

SEQ ID NO: 1283 - DNA, 23 bp, Artificial Sequence
  Synthetic Polynucleotide
tggccrgcaagtggcaccttggg

SEQ ID NO: 1284 - DNA, 23 bp, Artificial Sequence
  Synthetic Polynucleotide
atggccrgcaagtggcaccttgg

SEQ ID NO: 1285 - DNA, 23 bp, Artificial Sequence
  Synthetic Polynucleotide
cgaccagrtaggaaccacccggg

SEQ ID NO: 1286 - DNA, 23 bp, Artificial Sequence
  Synthetic Polynucleotide
acgaccagrtaggaaccacccgg

SEQ ID NO: 1287 - DNA, 23 bp, Artificial Sequence
  Synthetic Polynucleotide
cccaggrtaacccctccccgtgg

SEQ ID NO: 1288 - DNA, 23 bp, Artificial Sequence
  Synthetic Polynucleotide
gttcrgatgggcatgtaccctgg

SEQ ID NO: 1289 - DNA, 23 bp, Artificial Sequence
  Synthetic Polynucleotide
atgragctggatgcagctgtggg

SEQ ID NO: 1290 - DNA, 23 bp, Artificial Sequence
  Synthetic Polynucleotide
gatgragctggatgcagctgtgg

SEQ ID NO: 1291 - DNA, 23 bp, Artificial Sequence
  Synthetic Polynucleotide
cctggtgcccagctyccgggggg

SEQ ID NO: 1292 - DNA, 23 bp, Artificial Sequence
  Synthetic Polynucleotide
cctgagggggccttcctgcyccc

SEQ ID NO: 1293 - DNA, 23 bp, Artificial Sequence
  Synthetic Polynucleotide
cctgcccccaggcgtgayccacg

SEQ ID NO: 1294 - DNA, 23 bp, Artificial Sequence
  Synthetic Polynucleotide
cccttcttcctgtactatgyctc

SEQ ID NO: 1295 - DNA, 23 bp, Artificial Sequence
  Synthetic Polynucleotide
ccttcttcctgtactatgyctct

SEQ ID NO: 1296 - DNA, 23 bp, Artificial Sequence
  Synthetic Polynucleotide
cccagacctgagaccatgygtat

SEQ ID NO: 1297 - DNA, 23 bp, Artificial Sequence
  Synthetic Polynucleotide
ccagacctgagaccatgygtatg

SEQ ID NO: 1298 - DNA, 23 bp, Artificial Sequence
  Synthetic Polynucleotide
cccacagtgataccaytgcagac

SEQ ID NO: 1299 - DNA, 23 bp, Artificial Sequence
  Synthetic Polynucleotide
ccacagtgataccaytgcagacc

SEQ ID NO: 1300 - DNA, 23 bp, Artificial Sequence
  Synthetic Polynucleotide
cccagrtcccaggaacagcatgg

SEQ ID NO: 1301 - DNA, 23 bp, Artificial Sequence
  Synthetic Polynucleotide
tcgcrgagccagctgctcactgg

SEQ ID NO: 1302 - DNA, 23 bp, Artificial Sequence
  Synthetic Polynucleotide
cggtgcctrctatggaagaaagg

SEQ ID NO: 1303 - DNA, 23 bp, Artificial Sequence
  Synthetic Polynucleotide
ccctgctgtggcccgttcyccct

SEQ ID NO: 1304 - DNA, 23 bp, Artificial Sequence
  Synthetic Polynucleotide
cctgctgtggcccgttcyccctc

SEQ ID NO: 1305 - DNA, 23 bp, Artificial Sequence
  Synthetic Polynucleotide
tcggrccaagtggcgcaagcggg

SEQ ID NO: 1306 - DNA, 23 bp, Artificial Sequence
  Synthetic Polynucleotide
gtcggrccaagtggcgcaagcgg

SEQ ID NO: 1307 - DNA, 23 bp, Artificial Sequence
  Synthetic Polynucleotide
ccgaggcccgagtcyaggtgagc

SEQ ID NO: 1308 - DNA, 23 bp, Artificial Sequence
  Synthetic Polynucleotide
ccagaagacgcactaccyggacg

SEQ ID NO: 1309 - DNA, 23 bp, Artificial Sequence
  Synthetic Polynucleotide
cctcggagcggcagtgttcygac

SEQ ID NO: 1310 - DNA, 23 bp, Artificial Sequence
  Synthetic Polynucleotide
actcacrttggtcctgaaggagg

SEQ ID NO: 1311 - DNA, 23 bp, Artificial Sequence
  Synthetic Polynucleotide
ccgatgccgaggccaccacygcc

SEQ ID NO: 1312 - DNA, 23 bp, Artificial Sequence
  Synthetic Polynucleotide
tggccrgtttgtgggtgcagtgg

SEQ ID NO: 1313 - DNA, 23 bp, Artificial Sequence
  Synthetic Polynucleotide
gcagaggcrtgagtcctacaggg

SEQ ID NO: 1314 - DNA, 23 bp, Artificial Sequence
  Synthetic Polynucleotide
cccagatgccattcygccaggcc

SEQ ID NO: 1315 - DNA, 23 bp, Artificial Sequence
  Synthetic Polynucleotide
ccacgccgtggcactgaccygag

SEQ ID NO: 1316 - DNA, 23 bp, Artificial Sequence
  Synthetic Polynucleotide
ccgtggcactgaccygagactct

SEQ ID NO: 1317 - DNA, 23 bp, Artificial Sequence
  Synthetic Polynucleotide
ccacacagccaatgagygccgcc

SEQ ID NO: 1318 - DNA, 23 bp, Artificial Sequence
  Synthetic Polynucleotide
ccactgacccttctgccygcacg

SEQ ID NO: 1319 - DNA, 23 bp, Artificial Sequence
  Synthetic Polynucleotide
gcatrgtaaaaactgagtagagg

SEQ ID NO: 1320 - DNA, 23 bp, Artificial Sequence
  Synthetic Polynucleotide
ccttatagagacatygagctgct

SEQ ID NO: 1321 - DNA, 23 bp, Artificial Sequence
  Synthetic Polynucleotide
ccttttggctttttcaygagatt

SEQ ID NO: 1322 - DNA, 23 bp, Artificial Sequence
  Synthetic Polynucleotide
ccaagcagttatttgtatayagt

SEQ ID NO: 1323 - DNA, 23 bp, Artificial Sequence
  Synthetic Polynucleotide
cccattatcgctgtggcayagtc

SEQ ID NO: 1324 - DNA, 23 bp, Artificial Sequence
  Synthetic Polynucleotide
ccattatcgctgtggcayagtcc

SEQ ID NO: 1325 - DNA, 23 bp, Artificial Sequence
  Synthetic Polynucleotide
ccaggctgccattattattyaga

SEQ ID NO: 1326 - DNA, 23 bp, Artificial Sequence
  Synthetic Polynucleotide
ccactcaaagaaggcygagtaag

SEQ ID NO: 1327 - DNA, 23 bp, Artificial Sequence
  Synthetic Polynucleotide
caagggccrcaatgacctgatgg

SEQ ID NO: 1328 - DNA, 23 bp, Artificial Sequence
  Synthetic Polynucleotide
taccrgtgcgtaagactctatgg

SEQ ID NO: 1329 - DNA, 23 bp, Artificial Sequence
  Synthetic Polynucleotide
cagctacraggctggaatcctgg

SEQ ID NO: 1330 - DNA, 23 bp, Artificial Sequence
  Synthetic Polynucleotide
cgtgggccrtattgacatcgtgg

SEQ ID NO: 1331 - DNA, 23 bp, Artificial Sequence
  Synthetic Polynucleotide
ccaagtcccaggagygagtggaa

SEQ ID NO: 1332 - DNA, 23 bp, Artificial Sequence
  Synthetic Polynucleotide
cctcgactcccgccagaygctat

SEQ ID NO: 1333 - DNA, 23 bp, Artificial Sequence
  Synthetic Polynucleotide
ccaggtgtacatcctcggcyggg

SEQ ID NO: 1334 - DNA, 23 bp, Artificial Sequence
  Synthetic Polynucleotide
ccttcaccatggacygggaagtg

SEQ ID NO: 1335 - DNA, 23 bp, Artificial Sequence
  Synthetic Polynucleotide
ccagccacccgacagygagatgg

SEQ ID NO: 1336 - DNA, 23 bp, Artificial Sequence
  Synthetic Polynucleotide
ccatctgttgagcccyaggttgg

SEQ ID NO: 1337 - DNA, 23 bp, Artificial Sequence
  Synthetic Polynucleotide
ccttggcagaacaayagccaaaa

SEQ ID NO: 1338 - DNA, 23 bp, Artificial Sequence
  Synthetic Polynucleotide
ccgcttgtcagtctygcaagaag

SEQ ID NO: 1339 - DNA, 23 bp, Artificial Sequence
  Synthetic Polynucleotide
ccaaattcttggaaaaaygcctc

SEQ ID NO: 1340 - DNA, 23 bp, Artificial Sequence
  Synthetic Polynucleotide
cctttgatagtcagtcaaytttg

SEQ ID NO: 1341 - DNA, 23 bp, Artificial Sequence
  Synthetic Polynucleotide
tgaattrggatgctgtttttagg

SEQ ID NO: 1342 - DNA, 23 bp, Artificial Sequence
  Synthetic Polynucleotide
cctttgaagcttcagyaaacagc

SEQ ID NO: 1343 - DNA, 23 bp, Artificial Sequence
  Synthetic Polynucleotide
ataccrcagcacccgcttctggg

SEQ ID NO: 1344 - DNA, 23 bp, Artificial Sequence
  Synthetic Polynucleotide
aataccrcagcacccgcttctgg

SEQ ID NO: 1345 - DNA, 23 bp, Artificial Sequence
  Synthetic Polynucleotide
gggagcrtgtgctgggtgagagg

SEQ ID NO: 1346 - DNA, 23 bp, Artificial Sequence
  Synthetic Polynucleotide
cctggaggcggtggagaygctgg

SEQ ID NO: 1347 - DNA, 23 bp, Artificial Sequence
  Synthetic Polynucleotide
ccctccgcatgtaccygctcaag

SEQ ID NO: 1348 - DNA, 23 bp, Artificial Sequence
  Synthetic Polynucleotide
cctccgcatgtaccygctcaagt

SEQ ID NO: 1349 - DNA, 23 bp, Artificial Sequence
  Synthetic Polynucleotide
ccatctgctcggacaagaygggc

SEQ ID NO: 1350 - DNA, 23 bp, Artificial Sequence
  Synthetic Polynucleotide
ccggcgatcaccccatcayggcc

SEQ ID NO: 1351 - DNA, 23 bp, Artificial Sequence
  Synthetic Polynucleotide
cccgttcctgaccccygagctgt

SEQ ID NO: 1352 - DNA, 23 bp, Artificial Sequence
  Synthetic Polynucleotide
ccgttcctgaccccygagctgtc

SEQ ID NO: 1353 - DNA, 23 bp, Artificial Sequence
  Synthetic Polynucleotide
cctgaggccctgatccyggtgca

SEQ ID NO: 1354 - DNA, 23 bp, Artificial Sequence
  Synthetic Polynucleotide
cgtcrgggaagttgtctggtagg

SEQ ID NO: 1355 - DNA, 23 bp, Artificial Sequence
  Synthetic Polynucleotide
ccaacgtcrgggaagttgtctgg

SEQ ID NO: 1356 - DNA, 23 bp, Artificial Sequence
  Synthetic Polynucleotide
tacggrgctgagcctggaacagg

SEQ ID NO: 1357 - DNA, 23 bp, Artificial Sequence
  Synthetic Polynucleotide
gctgtarcagcaattcctgaagg

SEQ ID NO: 1358 - DNA, 23 bp, Artificial Sequence
  Synthetic Polynucleotide
ccttttagtcttgayagtgttgc

SEQ ID NO: 1359 - DNA, 23 bp, Artificial Sequence
  Synthetic Polynucleotide
ggaartaagtgtcccatagctgg

SEQ ID NO: 1360 - DNA, 23 bp, Artificial Sequence
  Synthetic Polynucleotide
tgcractgcactggtaaggatgg

SEQ ID NO: 1361 - DNA, 23 bp, Artificial Sequence
  Synthetic Polynucleotide
gccctgcractgcactggtaagg

SEQ ID NO: 1362 - DNA, 23 bp, Artificial Sequence
  Synthetic Polynucleotide
cctcagcctggctcatgcaygtg

SEQ ID NO: 1363 - DNA, 23 bp, Artificial Sequence
  Synthetic Polynucleotide
cccgtttgggattgatcyggtaa

SEQ ID NO: 1364 - DNA, 23 bp, Artificial Sequence
  Synthetic Polynucleotide
ccgtttgggattgatcyggtaat

SEQ ID NO: 1365 - DNA, 23 bp, Artificial Sequence
  Synthetic Polynucleotide
gagcrggcaggtgcttgaggtgg

SEQ ID NO: 1366 - DNA, 23 bp, Artificial Sequence
  Synthetic Polynucleotide
gaggagcrggcaggtgcttgagg

SEQ ID NO: 1367 - DNA, 23 bp, Artificial Sequence
  Synthetic Polynucleotide
cctcagcgaattttaccctygag

SEQ ID NO: 1368 - DNA, 23 bp, Artificial Sequence
  Synthetic Polynucleotide
ccaagcctctatcayagttctgt

SEQ ID NO: 1369 - DNA, 23 bp, Artificial Sequence
  Synthetic Polynucleotide
cgtgrgcgtggccagccccaggg

SEQ ID NO: 1370 - DNA, 23 bp, Artificial Sequence
  Synthetic Polynucleotide
ccgtgrgcgtggccagccccagg

SEQ ID NO: 1371 - DNA, 23 bp, Artificial Sequence
  Synthetic Polynucleotide
gtaatcrgttttatcgattttgg

SEQ ID NO: 1372 - DNA, 23 bp, Artificial Sequence
  Synthetic Polynucleotide
gggccggtrgctggaacacttgg

SEQ ID NO: 1373 - DNA, 23 bp, Artificial Sequence
  Synthetic Polynucleotide
tcctrtaagttgaatgccttggg

SEQ ID NO: 1374 - DNA, 23 bp, Artificial Sequence
  Synthetic Polynucleotide
ttcctrtaagttgaatgccttgg

SEQ ID NO: 1375 - DNA, 23 bp, Artificial Sequence
  Synthetic Polynucleotide
ccggaacccaagttcrtcacgtt

SEQ ID NO: 1376 - DNA, 23 bp, Artificial Sequence
  Synthetic Polynucleotide
cccggaagcactgtaattgyggg

SEQ ID NO: 1377 - DNA, 23 bp, Artificial Sequence
  Synthetic Polynucleotide
ccggaagcactgtaattgygggg

SEQ ID NO: 1378 - DNA, 23 bp, Artificial Sequence
  Synthetic Polynucleotide
ctctcccratgaaggtgccctgg

SEQ ID NO: 1379 - DNA, 23 bp, Artificial Sequence
  Synthetic Polynucleotide
aggargaggattattttaacagg

SEQ ID NO: 1380 - DNA, 23 bp, Artificial Sequence
  Synthetic Polynucleotide
ccaggagcttgatgttaaaygaa

SEQ ID NO: 1381 - DNA, 23 bp, Artificial Sequence
  Synthetic Polynucleotide
ctcargtcgatttagtaacaggg

SEQ ID NO: 1382 - DNA, 23 bp, Artificial Sequence
  Synthetic Polynucleotide
tctcargtcgatttagtaacagg

SEQ ID NO: 1383 - DNA, 23 bp, Artificial Sequence
  Synthetic Polynucleotide
ctctrctatgagctgctggtggg

SEQ ID NO: 1384 - DNA, 23 bp, Artificial Sequence
  Synthetic Polynucleotide
gctctrctatgagctgctggtgg

SEQ ID NO: 1385 - DNA, 23 bp, Artificial Sequence
  Synthetic Polynucleotide
agtgctctrctatgagctgctgg

SEQ ID NO: 1386 - DNA, 23 bp, Artificial Sequence
  Synthetic Polynucleotide
agtccrgccagaaggcgtgcggg

SEQ ID NO: 1387 - DNA, 23 bp, Artificial Sequence
  Synthetic Polynucleotide
cagtccrgccagaaggcgtgcgg

SEQ ID NO: 1388 - DNA, 23 bp, Artificial Sequence
  Synthetic Polynucleotide
ccgtcgccctgccagtycggcca

SEQ ID NO: 1389 - DNA, 23 bp, Artificial Sequence
  Synthetic Polynucleotide
cctgacaccatgctgcycgcctg

SEQ ID NO: 1390 - DNA, 23 bp, Artificial Sequence
  Synthetic Polynucleotide
ccagatgccctgtgtygggccgt

SEQ ID NO: 1391 - DNA, 23 bp, Artificial Sequence
  Synthetic Polynucleotide
cctggaaggccaccgacygcttc

SEQ ID NO: 1392 - DNA, 23 bp, Artificial Sequence
  Synthetic Polynucleotide
atctgtgrgggggcaacagcggg

SEQ ID NO: 1393 - DNA, 23 bp, Artificial Sequence
  Synthetic Polynucleotide
catctgtgrgggggcaacagcgg

SEQ ID NO: 1394 - DNA, 23 bp, Artificial Sequence
  Synthetic Polynucleotide
ccgctcgtctccaggcgaaygag

SEQ ID NO: 1395 - DNA, 23 bp, Artificial Sequence
  Synthetic Polynucleotide
ggtrtggagggagttgcaggtgg

SEQ ID NO: 1396 - DNA, 23 bp, Artificial Sequence
  Synthetic Polynucleotide
gaaggtrtggagggagttgcagg

SEQ ID NO: 1397 - DNA, 23 bp, Artificial Sequence
  Synthetic Polynucleotide
cgcccrccgcagcagcttcatgg

SEQ ID NO: 1398 - DNA, 23 bp, Artificial Sequence
  Synthetic Polynucleotide
ccgagagcacgtagcygccgccc

SEQ ID NO: 1399 - DNA, 23 bp, Artificial Sequence
  Synthetic Polynucleotide
gtgcrtcaggccaggagagacgg

SEQ ID NO: 1400 - DNA, 23 bp, Artificial Sequence
  Synthetic Polynucleotide
ccaatggcccttccygggagggc

SEQ ID NO: 1401 - DNA, 23 bp, Artificial Sequence
  Synthetic Polynucleotide
cttcgtgrcagagcccatggggg

SEQ ID NO: 1402 - DNA, 23 bp, Artificial Sequence
  Synthetic Polynucleotide
acttcgtgrcagagcccatgggg

SEQ ID NO: 1403 - DNA, 23 bp, Artificial Sequence
  Synthetic Polynucleotide
tctgraaggctccttcgagctgg

SEQ ID NO: 1404 - DNA, 23 bp, Artificial Sequence
  Synthetic Polynucleotide
aagagrtaaataaataacatggg

SEQ ID NO: 1405 - DNA, 23 bp, Artificial Sequence
  Synthetic Polynucleotide
aaagagrtaaataaataacatgg

SEQ ID NO: 1406 - DNA, 23 bp, Artificial Sequence
  Synthetic Polynucleotide
ccttctgttcagtcyggggctac

SEQ ID NO: 1407 - DNA, 23 bp, Artificial Sequence
  Synthetic Polynucleotide
cccatgtatggcagtygatttgg

SEQ ID NO: 1408 - DNA, 23 bp, Artificial Sequence
  Synthetic Polynucleotide
ccatgtatggcagtygatttggt

SEQ ID NO: 1409 - DNA, 23 bp, Artificial Sequence
  Synthetic Polynucleotide
ccttttgtttgggayatcagacg

SEQ ID NO: 1410 - DNA, 23 bp, Artificial Sequence
  Synthetic Polynucleotide
cccaggtgggcgacgagygagac

SEQ ID NO: 1411 - DNA, 23 bp, Artificial Sequence
  Synthetic Polynucleotide
ccaggtgggcgacgagygagact

SEQ ID NO: 1412 - DNA, 23 bp, Artificial Sequence
  Synthetic Polynucleotide
cctgcagcggtgggggcggygta

SEQ ID NO: 1413 - DNA, 23 bp, Artificial Sequence
  Synthetic Polynucleotide
cccccacgtgagaggyggcctcc

SEQ ID NO: 1414 - DNA, 23 bp, Artificial Sequence
  Synthetic Polynucleotide
ccccacgtgagaggyggcctccc

SEQ ID NO: 1415 - DNA, 23 bp, Artificial Sequence
  Synthetic Polynucleotide
cctctccactggccaygcagatc

SEQ ID NO: 1416 - DNA, 23 bp, Artificial Sequence
  Synthetic Polynucleotide
ccccatcatcttcttctgcygga

SEQ ID NO: 1417 - DNA, 23 bp, Artificial Sequence
  Synthetic Polynucleotide
cccatcatcttcttctgcyggaa

SEQ ID NO: 1418 - DNA, 23 bp, Artificial Sequence
  Synthetic Polynucleotide
ccatcatcttcttctgcyggaac

SEQ ID NO: 1419 - DNA, 23 bp, Artificial Sequence
  Synthetic Polynucleotide
ttcartctgtgatcaaaacaggg

SEQ ID NO: 1420 - DNA, 23 bp, Artificial Sequence
  Synthetic Polynucleotide
tttcartctgtgatcaaaacagg

SEQ ID NO: 1421 - DNA, 23 bp, Artificial Sequence
  Synthetic Polynucleotide
cctgaagcattttttgccyattg

SEQ ID NO: 1422 - DNA, 23 bp, Artificial Sequence
  Synthetic Polynucleotide
ccagtactgccagctggtgygac

SEQ ID NO: 1423 - DNA, 23 bp, Artificial Sequence
  Synthetic Polynucleotide
gcagarcctggtactcctggagg

SEQ ID NO: 1424 - DNA, 23 bp, Artificial Sequence
  Synthetic Polynucleotide
gcagcagarcctggtactcctgg

SEQ ID NO: 1425 - DNA, 23 bp, Artificial Sequence
  Synthetic Polynucleotide
ccctttggctatccacgcygccg

SEQ ID NO: 1426 - DNA, 23 bp, Artificial Sequence
  Synthetic Polynucleotide
cctttggctatccacgcygccgg

SEQ ID NO: 1427 - DNA, 23 bp, Artificial Sequence
  Synthetic Polynucleotide
caartggctaatgcccgcttagg

SEQ ID NO: 1428 - DNA, 23 bp, Artificial Sequence
  Synthetic Polynucleotide
ccagrtgtccctgttggctgtgg

SEQ ID NO: 1429 - DNA, 23 bp, Artificial Sequence
  Synthetic Polynucleotide
cccaggtggtgactgtggyggtg

SEQ ID NO: 1430 - DNA, 23 bp, Artificial Sequence
  Synthetic Polynucleotide
ccaggtggtgactgtggyggtgt

SEQ ID NO: 1431 - DNA, 23 bp, Artificial Sequence
  Synthetic Polynucleotide
cctgacttgtctagttgggyggc

SEQ ID NO: 1432 - DNA, 23 bp, Artificial Sequence
  Synthetic Polynucleotide
cctgatccaggagtyggcctcca

SEQ ID NO: 1433 - DNA, 23 bp, Artificial Sequence
  Synthetic Polynucleotide
ctgraaccagcacaaggagctgg

SEQ ID NO: 1434 - DNA, 23 bp, Artificial Sequence
  Synthetic Polynucleotide
ctacaccrctatgaatgatcggg

SEQ ID NO: 1435 - DNA, 23 bp, Artificial Sequence
  Synthetic Polynucleotide
actacaccrctatgaatgatcgg

SEQ ID NO: 1436 - DNA, 23 bp, Artificial Sequence
  Synthetic Polynucleotide
tgataattrctgtaaaacaaagg

SEQ ID NO: 1437 - DNA, 23 bp, Artificial Sequence
  Synthetic Polynucleotide
cctagggcattcactgyggtaca

SEQ ID NO: 1438 - DNA, 23 bp, Artificial Sequence
  Synthetic Polynucleotide
ccgttttatgtgtcagyagcaaa

SEQ ID NO: 1439 - DNA, 23 bp, Artificial Sequence
  Synthetic Polynucleotide
cccctttccactggytgaccacc

SEQ ID NO: 1440 - DNA, 23 bp, Artificial Sequence
  Synthetic Polynucleotide
agttrctgcattgctgacctggg

SEQ ID NO: 1441 - DNA, 23 bp, Artificial Sequence
  Synthetic Polynucleotide
gagttrctgcattgctgacctgg

SEQ ID NO: 1442 - DNA, 23 bp, Artificial Sequence
  Synthetic Polynucleotide
cccgcaattgctcatygagacct

SEQ ID NO: 1443 - DNA, 23 bp, Artificial Sequence
  Synthetic Polynucleotide
ccgcaattgctcatygagaccta

SEQ ID NO: 1444 - DNA, 23 bp, Artificial Sequence
  Synthetic Polynucleotide
acctrtgttattagtgactttgg

SEQ ID NO: 1445 - DNA, 23 bp, Artificial Sequence
  Synthetic Polynucleotide
ccaggatgcagaggctyggctta

SEQ ID NO: 1446 - DNA, 23 bp, Artificial Sequence
  Synthetic Polynucleotide
cctgcaatttcccatygagattt

SEQ ID NO: 1447 - DNA, 23 bp, Artificial Sequence
  Synthetic Polynucleotide
ccgtaccagagtacyagatggct

SEQ ID NO: 1448 - DNA, 23 bp, Artificial Sequence
  Synthetic Polynucleotide
cctggcgtctaaatgagygtcac

SEQ ID NO: 1449 - DNA, 23 bp, Artificial Sequence
  Synthetic Polynucleotide
ccaagtcaatcatcyacagagac

SEQ ID NO: 1450 - DNA, 23 bp, Artificial Sequence
  Synthetic Polynucleotide
gatgcctgracagaggacaatgg

SEQ ID NO: 1451 - DNA, 23 bp, Artificial Sequence
  Synthetic Polynucleotide
gtcagargagatgtggtcaatgg

SEQ ID NO: 1452 - DNA, 23 bp, Artificial Sequence
  Synthetic Polynucleotide
gatgcctrgacagaggacaatgg

SEQ ID NO: 1453 - DNA, 23 bp, Artificial Sequence
  Synthetic Polynucleotide
gaatrgatggtacagctgtgtgg

SEQ ID NO: 1454 - DNA, 23 bp, Artificial Sequence
  Synthetic Polynucleotide
gaatgratggtacagctgtgtgg

SEQ ID NO: 1455 - DNA, 23 bp, Artificial Sequence
  Synthetic Polynucleotide
taacagatrggctggaagtaagg

SEQ ID NO: 1456 - DNA, 23 bp, Artificial Sequence
  Synthetic Polynucleotide
ttcaragggaaccccttacctgg

SEQ ID NO: 1457 - DNA, 23 bp, Artificial Sequence
  Synthetic Polynucleotide
tttaargtgaagcagcatctggg

SEQ ID NO: 1458 - DNA, 23 bp, Artificial Sequence
  Synthetic Polynucleotide
atttaargtgaagcagcatctgg

SEQ ID NO: 1459 - DNA, 23 bp, Artificial Sequence
  Synthetic Polynucleotide
cccatacacatttggctyagggt

SEQ ID NO: 1460 - DNA, 23 bp, Artificial Sequence
  Synthetic Polynucleotide
ccatacacatttggctyagggtt

SEQ ID NO: 1461 - DNA, 23 bp, Artificial Sequence
  Synthetic Polynucleotide
ccaaacggagcagaatggtyaag

SEQ ID NO: 1462 - DNA, 23 bp, Artificial Sequence
  Synthetic Polynucleotide
cctgaaataaaaaagyaagaata

SEQ ID NO: 1463 - DNA, 23 bp, Artificial Sequence
  Synthetic Polynucleotide
ccaccaaggtccaaagygagcaa

SEQ ID NO: 1464 - DNA, 23 bp, Artificial Sequence
  Synthetic Polynucleotide
cctggcttagcaaggagcyaaca

SEQ ID NO: 1465 - DNA, 23 bp, Artificial Sequence
  Synthetic Polynucleotide
ccgtgccaaaagacttctayaga

SEQ ID NO: 1466 - DNA, 23 bp, Artificial Sequence
  Synthetic Polynucleotide
ccaaaagacttctayagagtgaa

SEQ ID NO: 1467 - DNA, 23 bp, Artificial Sequence
  Synthetic Polynucleotide
ccagaagaaagggccttcayagt

SEQ ID NO: 1468 - DNA, 23 bp, Artificial Sequence
  Synthetic Polynucleotide
tagatrgatcatatggaaactgg

SEQ ID NO: 1469 - DNA, 23 bp, Artificial Sequence
  Synthetic Polynucleotide
aacaaatrggcaggactcttagg

SEQ ID NO: 1470 - DNA, 23 bp, Artificial Sequence
  Synthetic Polynucleotide
aacaaatgrgcaggactcttagg

SEQ ID NO: 1471 - DNA, 23 bp, Artificial Sequence
  Synthetic Polynucleotide
catatrgaaactggcagctatgg

SEQ ID NO: 1472 - DNA, 23 bp, Artificial Sequence
  Synthetic Polynucleotide
gttttrgatagaccttaatgagg

SEQ ID NO: 1473 - DNA, 23 bp, Artificial Sequence
  Synthetic Polynucleotide
ccttgargtgagagagtaagagg

SEQ ID NO: 1474 - DNA, 23 bp, Artificial Sequence
  Synthetic Polynucleotide
agatgggtrgtatgctgttaagg

SEQ ID NO: 1475 - DNA, 23 bp, Artificial Sequence
  Synthetic Polynucleotide
ccatggaatctgctgaayaaaag

SEQ ID NO: 1476 - DNA, 23 bp, Artificial Sequence
  Synthetic Polynucleotide
ccaataatattcaaagagyaagg

SEQ ID NO: 1477 - DNA, 23 bp, Artificial Sequence
  Synthetic Polynucleotide
ccataatttaacacctagcyaaa

SEQ ID NO: 1478 - DNA, 23 bp, Artificial Sequence
  Synthetic Polynucleotide
ccagaacatttaatatccyaaaa

SEQ ID NO: 1479 - DNA, 23 bp, Artificial Sequence
  Synthetic Polynucleotide
cctaggcacaataaaagatygaa

SEQ ID NO: 1480 - DNA, 23 bp, Artificial Sequence
  Synthetic Polynucleotide
ccttattcactaaaattyaggag

SEQ ID NO: 1481 - DNA, 23 bp, Artificial Sequence
  Synthetic Polynucleotide
ccaagctacatattgyagaagag

SEQ ID NO: 1482 - DNA, 23 bp, Artificial Sequence
  Synthetic Polynucleotide
cccagaaagggtgcttcttyaac

SEQ ID NO: 1483 - DNA, 23 bp, Artificial Sequence
  Synthetic Polynucleotide
ccagaaagggtgcttcttyaact

SEQ ID NO: 1484 - DNA, 23 bp, Artificial Sequence
  Synthetic Polynucleotide
cctatttaaaactccayaaagga

SEQ ID NO: 1485 - DNA, 23 bp, Artificial Sequence
  Synthetic Polynucleotide
ttctttargactttctaaatggg

SEQ ID NO: 1486 - DNA, 23 bp, Artificial Sequence
  Synthetic Polynucleotide
tttctttargactttctaaatgg

SEQ ID NO: 1487 - DNA, 23 bp, Artificial Sequence
  Synthetic Polynucleotide
agtgcatrgaattgctagatggg

SEQ ID NO: 1488 - DNA, 23 bp, Artificial Sequence
  Synthetic Polynucleotide
aagtgcatrgaattgctagatgg

SEQ ID NO: 1489 - DNA, 23 bp, Artificial Sequence
  Synthetic Polynucleotide
ccaaatgtgaaagatctayaggt

SEQ ID NO: 1490 - DNA, 23 bp, Artificial Sequence
  Synthetic Polynucleotide
ccatattacacagccygagaact

SEQ ID NO: 1491 - DNA, 23 bp, Artificial Sequence
  Synthetic Polynucleotide
ggatcrgcttcattgtgctgggg

SEQ ID NO: 1492 - DNA, 23 bp, Artificial Sequence
  Synthetic Polynucleotide
cggatcrgcttcattgtgctggg

SEQ ID NO: 1493 - DNA, 23 bp, Artificial Sequence
  Synthetic Polynucleotide
ccggatcrgcttcattgtgctgg

SEQ ID NO: 1494 - DNA, 23 bp, Artificial Sequence
  Synthetic Polynucleotide
tggtgatcrggggcatcatctgg

SEQ ID NO: 1495 - DNA, 23 bp, Artificial Sequence
  Synthetic Polynucleotide
gctccagcrcctgagttgtatgg

SEQ ID NO: 1496 - DNA, 23 bp, Artificial Sequence
  Synthetic Polynucleotide
aagtrgcatacacacccctctgg

SEQ ID NO: 1497 - DNA, 23 bp, Artificial Sequence
  Synthetic Polynucleotide
catcagccrccaagaggccttgg

SEQ ID NO: 1498 - DNA, 23 bp, Artificial Sequence
  Synthetic Polynucleotide
aatgtcrtgttcagcaataatgg

SEQ ID NO: 1499 - DNA, 23 bp, Artificial Sequence
  Synthetic Polynucleotide
gatrggcttcacacagtacatgg

SEQ ID NO: 1500 - DNA, 23 bp, Artificial Sequence
  Synthetic Polynucleotide
ctatgrgcgcttgtatgagaggg

SEQ ID NO: 1501 - DNA, 23 bp, Artificial Sequence
  Synthetic Polynucleotide
tctatgrgcgcttgtatgagagg

SEQ ID NO: 1502 - DNA, 23 bp, Artificial Sequence
  Synthetic Polynucleotide
ctatgggcrcttgtatgagaggg

SEQ ID NO: 1503 - DNA, 23 bp, Artificial Sequence
  Synthetic Polynucleotide
tcaccrcttcaatgacacagagg

SEQ ID NO: 1504 - DNA, 23 bp, Artificial Sequence
  Synthetic Polynucleotide
ccacaccrgggaggagagcgtgg

SEQ ID NO: 1505 - DNA, 23 bp, Artificial Sequence
  Synthetic Polynucleotide
tccaartgtgtgccctggtcagg

SEQ ID NO: 1506 - DNA, 23 bp, Artificial Sequence
  Synthetic Polynucleotide
aagtgrcatacacacccctctgg

SEQ ID NO: 1507 - DNA, 23 bp, Artificial Sequence
  Synthetic Polynucleotide
ccctctggctctcatcagcygcc

SEQ ID NO: 1508 - DNA, 23 bp, Artificial Sequence
  Synthetic Polynucleotide
cctctggctctcatcagcygcca

SEQ ID NO: 1509 - DNA, 23 bp, Artificial Sequence
  Synthetic Polynucleotide
cctctgggctggtgayggcggct

SEQ ID NO: 1510 - DNA, 23 bp, Artificial Sequence
  Synthetic Polynucleotide
ccttgacatctatgaayagcaag

SEQ ID NO: 1511 - DNA, 23 bp, Artificial Sequence
  Synthetic Polynucleotide
cctctaggtgctccagygcctga

SEQ ID NO: 1512 - DNA, 23 bp, Artificial Sequence
  Synthetic Polynucleotide
cctgagttgtatggycatcaggg

SEQ ID NO: 1513 - DNA, 23 bp, Artificial Sequence
  Synthetic Polynucleotide
cccttgttgaccgctacygtaaa

SEQ ID NO: 1514 - DNA, 23 bp, Artificial Sequence
  Synthetic Polynucleotide
ccttgttgaccgctacygtaaac

SEQ ID NO: 1515 - DNA, 23 bp, Artificial Sequence
  Synthetic Polynucleotide
cccaagrcctacgtctctacagg

SEQ ID NO: 1516 - DNA, 23 bp, Artificial Sequence
  Synthetic Polynucleotide
ccaaacacatgactyggagtcag

SEQ ID NO: 1517 - DNA, 23 bp, Artificial Sequence
  Synthetic Polynucleotide
ccaaatttccagtcyggtggtcc

SEQ ID NO: 1518 - DNA, 23 bp, Artificial Sequence
  Synthetic Polynucleotide
ccatggtggagagcaygagataa

SEQ ID NO: 1519 - DNA, 23 bp, Artificial Sequence
  Synthetic Polynucleotide
ggcrgattgtattctggttgggg

SEQ ID NO: 1520 - DNA, 23 bp, Artificial Sequence
  Synthetic Polynucleotide
cggcrgattgtattctggttggg

SEQ ID NO: 1521 - DNA, 23 bp, Artificial Sequence
  Synthetic Polynucleotide
ccggcrgattgtattctggttgg

SEQ ID NO: 1522 - DNA, 23 bp, Artificial Sequence
  Synthetic Polynucleotide
cccgggtcatgctgayacagttt

SEQ ID NO: 1523 - DNA, 23 bp, Artificial Sequence
  Synthetic Polynucleotide
ccgggtcatgctgayacagtttg

SEQ ID NO: 1524 - DNA, 23 bp, Artificial Sequence
  Synthetic Polynucleotide
cccgtggccacgcagatcyagca

SEQ ID NO: 1525 - DNA, 23 bp, Artificial Sequence
  Synthetic Polynucleotide
ccgtggccacgcagatcyagcag

SEQ ID NO: 1526 - DNA, 23 bp, Artificial Sequence
  Synthetic Polynucleotide
cctgttcacaaagaaaaaygaga

SEQ ID NO: 1527 - DNA, 23 bp, Artificial Sequence
  Synthetic Polynucleotide
ccctcgaaggcccgccaygatga

SEQ ID NO: 1528 - DNA, 23 bp, Artificial Sequence
  Synthetic Polynucleotide
cctcgaaggcccgccaygatgac

SEQ ID NO: 1529 - DNA, 23 bp, Artificial Sequence
  Synthetic Polynucleotide
actcrgacaagtacacaagtggg

SEQ ID NO: 1530 - DNA, 23 bp, Artificial Sequence
  Synthetic Polynucleotide
cactcrgacaagtacacaagtgg

SEQ ID NO: 1531 - DNA, 23 bp, Artificial Sequence
  Synthetic Polynucleotide
cctggggaaaacctggggayagg

SEQ ID NO: 1532 - DNA, 23 bp, Artificial Sequence
  Synthetic Polynucleotide
tctggtcraaaagtcacatttgg

SEQ ID NO: 1533 - DNA, 23 bp, Artificial Sequence
  Synthetic Polynucleotide
ctgggacrcttcttcttctctgg

SEQ ID NO: 1534 - DNA, 23 bp, Artificial Sequence
  Synthetic Polynucleotide
cctggccctctccgcggcgyggc

SEQ ID NO: 1535 - DNA, 23 bp, Artificial Sequence
  Synthetic Polynucleotide
ccctctccgcggcgyggccatcg

SEQ ID NO: 1536 - DNA, 23 bp, Artificial Sequence
  Synthetic Polynucleotide
cccgagcaagtgattacytttaa

SEQ ID NO: 1537 - DNA, 23 bp, Artificial Sequence
  Synthetic Polynucleotide
ccgagcaagtgattacytttaaa

SEQ ID NO: 1538 - DNA, 23 bp, Artificial Sequence
  Synthetic Polynucleotide
actgggaarggcccaacaacggg

SEQ ID NO: 1539 - DNA, 23 bp, Artificial Sequence
  Synthetic Polynucleotide
tccrcctcttccgagctgcccgg

SEQ ID NO: 1540 - DNA, 23 bp, Artificial Sequence
  Synthetic Polynucleotide
aatrtcagccctactgggaaggg

SEQ ID NO: 1541 - DNA, 23 bp, Artificial Sequence
  Synthetic Polynucleotide
aaatrtcagccctactgggaagg

SEQ ID NO: 1542 - DNA, 23 bp, Artificial Sequence
  Synthetic Polynucleotide
gaccaaatrtcagccctactggg

SEQ ID NO: 1543 - DNA, 23 bp, Artificial Sequence
  Synthetic Polynucleotide
cccctttcagatcctgaygggcg

SEQ ID NO: 1544 - DNA, 23 bp, Artificial Sequence
  Synthetic Polynucleotide
ccctttcagatcctgaygggcga

SEQ ID NO: 1545 - DNA, 23 bp, Artificial Sequence
  Synthetic Polynucleotide
cctttcagatcctgaygggcgaa

SEQ ID NO: 1546 - DNA, 23 bp, Artificial Sequence
  Synthetic Polynucleotide
cccttacaggtgctgygatactt

SEQ ID NO: 1547 - DNA, 23 bp, Artificial Sequence
  Synthetic Polynucleotide
ccttacaggtgctgygatacttt

SEQ ID NO: 1548 - DNA, 23 bp, Artificial Sequence
  Synthetic Polynucleotide
ccaagccgctgaccygacacatg

SEQ ID NO: 1549 - DNA, 23 bp, Artificial Sequence
  Synthetic Polynucleotide
cccttgcgaggagacttaygtga

SEQ ID NO: 1550 - DNA, 23 bp, Artificial Sequence
  Synthetic Polynucleotide
ccttgcgaggagacttaygtgaa

SEQ ID NO: 1551 - DNA, 23 bp, Artificial Sequence
  Synthetic Polynucleotide
tggttctcrgtgtgcttagcggg

SEQ ID NO: 1552 - DNA, 23 bp, Artificial Sequence
  Synthetic Polynucleotide
ttagcrggtaagcaggaccaagg

SEQ ID NO: 1553 - DNA, 23 bp, Artificial Sequence
  Synthetic Polynucleotide
tggttctcrgtgtgttgagcggg

SEQ ID NO: 1554 - DNA, 23 bp, Artificial Sequence
  Synthetic Polynucleotide
ttgrcgtcctgagtgggtgaggg

SEQ ID NO: 1555 - DNA, 23 bp, Artificial Sequence
  Synthetic Polynucleotide
cttgrcgtcctgagtgggtgagg

SEQ ID NO: 1556 - DNA, 23 bp, Artificial Sequence
  Synthetic Polynucleotide
ccgctgaggaccccatcygagcc

SEQ ID NO: 1557 - DNA, 23 bp, Artificial Sequence
  Synthetic Polynucleotide
tccrctgcatccgcctcctgagg

SEQ ID NO: 1558 - DNA, 23 bp, Artificial Sequence
  Synthetic Polynucleotide
ccttatagctcctcaaaytaaat

SEQ ID NO: 1559 - DNA, 23 bp, Artificial Sequence
  Synthetic Polynucleotide
ccgctcttcctcctyagccccac

SEQ ID NO: 1560 - DNA, 23 bp, Artificial Sequence
  Synthetic Polynucleotide
cctgccgcrccgcgccagccagg

SEQ ID NO: 1561 - DNA, 23 bp, Artificial Sequence
  Synthetic Polynucleotide
ccgcgggcgcagtcactcayccg

SEQ ID NO: 1562 - DNA, 23 bp, Artificial Sequence
  Synthetic Polynucleotide
ccttgcccaggccgcccaygtac

SEQ ID NO: 1563 - DNA, 23 bp, Artificial Sequence
  Synthetic Polynucleotide
cctgatgcagaagaaccggygga

SEQ ID NO: 1564 - DNA, 23 bp, Artificial Sequence
  Synthetic Polynucleotide
cccaccggatgagacctytctct

SEQ ID NO: 1565 - DNA, 23 bp, Artificial Sequence
  Synthetic Polynucleotide
ccaccggatgagacctytctctt

SEQ ID NO: 1566 - DNA, 23 bp, Artificial Sequence
  Synthetic Polynucleotide
ggtgaragctccgactttgacgg

SEQ ID NO: 1567 - DNA, 23 bp, Artificial Sequence
  Synthetic Polynucleotide
gaccrgccacaagggctacgtgg

SEQ ID NO: 1568 - DNA, 23 bp, Artificial Sequence
  Synthetic Polynucleotide
cccrgcctcccgggtccccaggg

SEQ ID NO: 1569 - DNA, 23 bp, Artificial Sequence
  Synthetic Polynucleotide
gcccrgcctcccgggtccccagg

SEQ ID NO: 1570 - DNA, 23 bp, Artificial Sequence
  Synthetic Polynucleotide
cccttcagtgttgtaygacgatg

SEQ ID NO: 1571 - DNA, 23 bp, Artificial Sequence
  Synthetic Polynucleotide
ccttcagtgttgtaygacgatgt

SEQ ID NO: 1572 - DNA, 23 bp, Artificial Sequence
  Synthetic Polynucleotide
ccatggagaagaccaaayaggag

SEQ ID NO: 1573 - DNA, 23 bp, Artificial Sequence
  Synthetic Polynucleotide
ccggaagatccacgagyaggggc

SEQ ID NO: 1574 - DNA, 23 bp, Artificial Sequence
  Synthetic Polynucleotide
ccagaaacagtagagyagctgag

SEQ ID NO: 1575 - DNA, 23 bp, Artificial Sequence
  Synthetic Polynucleotide
ccttccgtatccatcgaagyaga

SEQ ID NO: 1576 - DNA, 23 bp, Artificial Sequence
  Synthetic Polynucleotide
ccgtatccatcgaagyagatgct

SEQ ID NO: 1577 - DNA, 23 bp, Artificial Sequence
  Synthetic Polynucleotide
tcatcgrggagccccaggactgg

SEQ ID NO: 1578 - DNA, 23 bp, Artificial Sequence
  Synthetic Polynucleotide
gatcragtttctgtcgtggacgg

SEQ ID NO: 1579 - DNA, 23 bp, Artificial Sequence
  Synthetic Polynucleotide
aggagatcragtttctgtcgtgg

SEQ ID NO: 1580 - DNA, 23 bp, Artificial Sequence
  Synthetic Polynucleotide
caggaaarggatcattgaggggg

SEQ ID NO: 1581 - DNA, 23 bp, Artificial Sequence
  Synthetic Polynucleotide
ccaggaaarggatcattgagggg

SEQ ID NO: 1582 - DNA, 23 bp, Artificial Sequence
  Synthetic Polynucleotide
gtggtggragcaactggctcagg

SEQ ID NO: 1583 - DNA, 23 bp, Artificial Sequence
  Synthetic Polynucleotide
ccaggtataatttcygtgggttt

SEQ ID NO: 1584 - DNA, 23 bp, Artificial Sequence
  Synthetic Polynucleotide
ttctgccratgtgaaattaaagg

SEQ ID NO: 1585 - DNA, 23 bp, Artificial Sequence
  Synthetic Polynucleotide
cttcraccaggcgcccgtggtgg

SEQ ID NO: 1586 - DNA, 23 bp, Artificial Sequence
  Synthetic Polynucleotide
gggcttcraccaggcgcccgtgg

SEQ ID NO: 1587 - DNA, 23 bp, Artificial Sequence
  Synthetic Polynucleotide
cctttatctttccaggaacycga

SEQ ID NO: 1588 - DNA, 23 bp, Artificial Sequence
  Synthetic Polynucleotide
cctcggcccagacgcttaygaag

SEQ ID NO: 1589 - DNA, 23 bp, Artificial Sequence
  Synthetic Polynucleotide
ccctcctgccctgcgcytcacag

SEQ ID NO: 1590 - DNA, 23 bp, Artificial Sequence
  Synthetic Polynucleotide
cctcctgccctgcgcytcacaga

SEQ ID NO: 1591 - DNA, 23 bp, Artificial Sequence
  Synthetic Polynucleotide
ccgcgtgcgggacgagtahcccc

SEQ ID NO: 1592 - DNA, 23 bp, Artificial Sequence
  Synthetic Polynucleotide
ccaccaaatacttcaacyagctc

SEQ ID NO: 1593 - DNA, 23 bp, Artificial Sequence
  Synthetic Polynucleotide
ccaaatacttcaacyagctcatc

SEQ ID NO: 1594 - DNA, 23 bp, Artificial Sequence
  Synthetic Polynucleotide
gtccagccrcatcctgaagctgg

SEQ ID NO: 1595 - DNA, 23 bp, Artificial Sequence
  Synthetic Polynucleotide
ccatrtgagtgatccggacacgg

SEQ ID NO: 1596 - DNA, 23 bp, Artificial Sequence
  Synthetic Polynucleotide
ccgggacacttgactyaggagca

SEQ ID NO: 1597 - DNA, 23 bp, Artificial Sequence
  Synthetic Polynucleotide
ccatcaagaacccccgctygact

SEQ ID NO: 1598 - DNA, 23 bp, Artificial Sequence
  Synthetic Polynucleotide
ccagcagggccagaacyagctct

SEQ ID NO: 1599 - DNA, 23 bp, Artificial Sequence
  Synthetic Polynucleotide
tacrtgcttcctgaaccctttgg

SEQ ID NO: 1600 - DNA, 23 bp, Artificial Sequence
  Synthetic Polynucleotide
ccatggcactggcttcaygtcct

SEQ ID NO: 1601 - DNA, 23 bp, Artificial Sequence
  Synthetic Polynucleotide
caagrtgcgcgaggccggtgggg

SEQ ID NO: 1602 - DNA, 23 bp, Artificial Sequence
  Synthetic Polynucleotide
tcaagrtgcgcgaggccggtggg

SEQ ID NO: 1603 - DNA, 23 bp, Artificial Sequence
  Synthetic Polynucleotide
ttcaagrtgcgcgaggccggtgg

SEQ ID NO: 1604 - DNA, 23 bp, Artificial Sequence
  Synthetic Polynucleotide
cgagrgctactatttctgctcgg

SEQ ID NO: 1605 - DNA, 23 bp, Artificial Sequence
  Synthetic Polynucleotide
cccttgttctgttttyggacctg

SEQ ID NO: 1606 - DNA, 23 bp, Artificial Sequence
  Synthetic Polynucleotide
ccttgttctgttttyggacctgc

SEQ ID NO: 1607 - DNA, 23 bp, Artificial Sequence
  Synthetic Polynucleotide
ccctcccaggtccctcyggtcct

SEQ ID NO: 1608 - DNA, 23 bp, Artificial Sequence
  Synthetic Polynucleotide
cctcccaggtccctcyggtcctg

SEQ ID NO: 1609 - DNA, 23 bp, Artificial Sequence
  Synthetic Polynucleotide
cccttgctggaatattacyggga

SEQ ID NO: 1610 - DNA, 23 bp, Artificial Sequence
  Synthetic Polynucleotide
ccttgctggaatattacygggac

SEQ ID NO: 1611 - DNA, 23 bp, Artificial Sequence
  Synthetic Polynucleotide
ccttggccgtggggccaygggac

SEQ ID NO: 1612 - DNA, 23 bp, Artificial Sequence
  Synthetic Polynucleotide
gtttrggggtaagtccggcatgg

SEQ ID NO: 1613 - DNA, 23 bp, Artificial Sequence
  Synthetic Polynucleotide
gtttggggrtaagtccggcatgg

SEQ ID NO: 1614 - DNA, 23 bp, Artificial Sequence
  Synthetic Polynucleotide
ttaractgaaaatattcctgtgg

SEQ ID NO: 1615 - DNA, 23 bp, Artificial Sequence
  Synthetic Polynucleotide
ctcttgrctctgccaggagccgg

SEQ ID NO: 1616 - DNA, 23 bp, Artificial Sequence
  Synthetic Polynucleotide
ctcttrgctctgccaggagccgg

SEQ ID NO: 1617 - DNA, 23 bp, Artificial Sequence
  Synthetic Polynucleotide
cccccataccagaacctygaact

SEQ ID NO: 1618 - DNA, 23 bp, Artificial Sequence
  Synthetic Polynucleotide
ccccataccagaacctygaacta

SEQ ID NO: 1619 - DNA, 23 bp, Artificial Sequence
  Synthetic Polynucleotide
cccataccagaacctygaactat

SEQ ID NO: 1620 - DNA, 23 bp, Artificial Sequence
  Synthetic Polynucleotide
ccataccagaacctygaactata

SEQ ID NO: 1621 - DNA, 23 bp, Artificial Sequence
  Synthetic Polynucleotide
ccaactggaccattyagtacaac

SEQ ID NO: 1622 - DNA, 23 bp, Artificial Sequence
  Synthetic Polynucleotide
ccgagaaccacaagygtctcccc

SEQ ID NO: 1623 - DNA, 23 bp, Artificial Sequence
  Synthetic Polynucleotide
ctgrggcaccaccatgctcctgg

SEQ ID NO: 1624 - DNA, 23 bp, Artificial Sequence
  Synthetic Polynucleotide
gcggcaccrggtgccaggtgtgg

SEQ ID NO: 1625 - DNA, 23 bp, Artificial Sequence
  Synthetic Polynucleotide
gtgarcagtgatggagggcctgg

SEQ ID NO: 1626 - DNA, 23 bp, Artificial Sequence
  Synthetic Polynucleotide
cccatcttcatcaacctgcytta

SEQ ID NO: 1627 - DNA, 23 bp, Artificial Sequence
  Synthetic Polynucleotide
ccatcttcatcaacctgcyttac

SEQ ID NO: 1628 - DNA, 23 bp, Artificial Sequence
  Synthetic Polynucleotide
ccttttgagccacgcacccyggt

SEQ ID NO: 1629 - DNA, 23 bp, Artificial Sequence
  Synthetic Polynucleotide
cctgctcaaacagatcagcyagg

SEQ ID NO: 1630 - DNA, 23 bp, Artificial Sequence
  Synthetic Polynucleotide
tccgtgracatgtggtcggtggg

SEQ ID NO: 1631 - DNA, 23 bp, Artificial Sequence
  Synthetic Polynucleotide
gtccgtgracatgtggtcggtgg

SEQ ID NO: 1632 - DNA, 23 bp, Artificial Sequence
  Synthetic Polynucleotide
tacagargtaagcccacccccgg

SEQ ID NO: 1633 - DNA, 23 bp, Artificial Sequence
  Synthetic Polynucleotide
cctttctttcagagcyagccatt

SEQ ID NO: 1634 - DNA, 23 bp, Artificial Sequence
  Synthetic Polynucleotide
ccagatggtatcggtcccyagaa

SEQ ID NO: 1635 - DNA, 23 bp, Artificial Sequence
  Synthetic Polynucleotide
ccagctgacagatacttgayaga

SEQ ID NO: 1636 - DNA, 23 bp, Artificial Sequence
  Synthetic Polynucleotide
ccacttccatctgagyagatgaa

SEQ ID NO: 1637 - DNA, 23 bp, Artificial Sequence
  Synthetic Polynucleotide
ccagcccttaacagctcaayaaa

SEQ ID NO: 1638 - DNA, 23 bp, Artificial Sequence
  Synthetic Polynucleotide
cccttaacagctcaayaaaccaa

SEQ ID NO: 1639 - DNA, 23 bp, Artificial Sequence
  Synthetic Polynucleotide
ccttaacagctcaayaaaccaaa

SEQ ID NO: 1640 - DNA, 23 bp, Artificial Sequence
  Synthetic Polynucleotide
cccttctggaagaaataacygaa

SEQ ID NO: 1641 - DNA, 23 bp, Artificial Sequence
  Synthetic Polynucleotide
ccttctggaagaaataacygaaa

SEQ ID NO: 1642 - DNA, 23 bp, Artificial Sequence
  Synthetic Polynucleotide
ccctgatcttctgacgttgyaga

SEQ ID NO: 1643 - DNA, 23 bp, Artificial Sequence
  Synthetic Polynucleotide
cctgatcttctgacgttgyagaa

SEQ ID NO: 1644 - DNA, 23 bp, Artificial Sequence
  Synthetic Polynucleotide
ccagcccttaacagctyaacaaa

SEQ ID NO: 1645 - DNA, 23 bp, Artificial Sequence
  Synthetic Polynucleotide
gagtrgcaagaggtggagaaggg

SEQ ID NO: 1646 - DNA, 23 bp, Artificial Sequence
  Synthetic Polynucleotide
cgagtrgcaagaggtggagaagg

SEQ ID NO: 1647 - DNA, 23 bp, Artificial Sequence
  Synthetic Polynucleotide
gatctccrgtgagccccgcacgg

SEQ ID NO: 1648 - DNA, 23 bp, Artificial Sequence
  Synthetic Polynucleotide
caccgrcccgcaggagactgcgg

SEQ ID NO: 1649 - DNA, 23 bp, Artificial Sequence
  Synthetic Polynucleotide
ccccacccatggtaggygatcca

SEQ ID NO: 1650 - DNA, 23 bp, Artificial Sequence
  Synthetic Polynucleotide
cccacccatggtaggygatccac

SEQ ID NO: 1651 - DNA, 23 bp, Artificial Sequence
  Synthetic Polynucleotide
ccacccatggtaggygatccaca

SEQ ID NO: 1652 - DNA, 23 bp, Artificial Sequence
  Synthetic Polynucleotide
ccatgtgacgaacactatyggag

SEQ ID NO: 1653 - DNA, 23 bp, Artificial Sequence
  Synthetic Polynucleotide
cctgcagctgtccctcyagaggt

SEQ ID NO: 1654 - DNA, 23 bp, Artificial Sequence
  Synthetic Polynucleotide
ggagcrggggtttgagtggctgg

SEQ ID NO: 1655 - DNA, 23 bp, Artificial Sequence
  Synthetic Polynucleotide
tgcgtcrgattctttctagatgg

SEQ ID NO: 1656 - DNA, 23 bp, Artificial Sequence
  Synthetic Polynucleotide
cctggcacccaggggaayaacag

SEQ ID NO: 1657 - DNA, 23 bp, Artificial Sequence
  Synthetic Polynucleotide
cccggcccacttcaccggcygct

SEQ ID NO: 1658 - DNA, 23 bp, Artificial Sequence
  Synthetic Polynucleotide
ccggcccacttcaccggcygcta

SEQ ID NO: 1659 - DNA, 23 bp, Artificial Sequence
  Synthetic Polynucleotide
cccacttcaccggcygctactgc

SEQ ID NO: 1660 - DNA, 23 bp, Artificial Sequence
  Synthetic Polynucleotide
tacaaatrttttgaaggttttgg

SEQ ID NO: 1661 - DNA, 23 bp, Artificial Sequence
  Synthetic Polynucleotide
tgtgatgrtatcaatgattgtgg

SEQ ID NO: 1662 - DNA, 23 bp, Artificial Sequence
  Synthetic Polynucleotide
cccggacccgcaggygagcctgt

SEQ ID NO: 1663 - DNA, 23 bp, Artificial Sequence
  Synthetic Polynucleotide
atactgctrggaagaagcaatgg

SEQ ID NO: 1664 - DNA, 23 bp, Artificial Sequence
  Synthetic Polynucleotide
ggtcactcrgcaatttccctggg

SEQ ID NO: 1665 - DNA, 23 bp, Artificial Sequence
  Synthetic Polynucleotide
aatatrgaaagttgcagatgagg

SEQ ID NO: 1666 - DNA, 23 bp, Artificial Sequence
  Synthetic Polynucleotide
tttccaracttcacttctaatgg

SEQ ID NO: 1667 - DNA, 23 bp, Artificial Sequence
  Synthetic Polynucleotide
accttatargtgggcctcttggg

SEQ ID NO: 1668 - DNA, 23 bp, Artificial Sequence
  Synthetic Polynucleotide
cagaraatgggatagagagctgg

SEQ ID NO: 1669 - DNA, 23 bp, Artificial Sequence
  Synthetic Polynucleotide
cagagaatrggatagagagctgg

SEQ ID NO: 1670 - DNA, 23 bp, Artificial Sequence
  Synthetic Polynucleotide
cctccggaaaatattcaycacca

SEQ ID NO: 1671 - DNA, 23 bp, Artificial Sequence
  Synthetic Polynucleotide
ccggaaaatattcaycaccatct

SEQ ID NO: 1672 - DNA, 23 bp, Artificial Sequence
  Synthetic Polynucleotide
ccaatcaactctataygaaaatt

SEQ ID NO: 1673 - DNA, 23 bp, Artificial Sequence
  Synthetic Polynucleotide
ccagggacttgcattggcayatt

SEQ ID NO: 1674 - DNA, 23 bp, Artificial Sequence
  Synthetic Polynucleotide
ccccacgcttcaggcaygaagga

SEQ ID NO: 1675 - DNA, 23 bp, Artificial Sequence
  Synthetic Polynucleotide
cccacgcttcaggcaygaaggag

SEQ ID NO: 1676 - DNA, 23 bp, Artificial Sequence
  Synthetic Polynucleotide
ccacgcttcaggcaygaaggagg

SEQ ID NO: 1677 - DNA, 23 bp, Artificial Sequence
  Synthetic Polynucleotide
ccaaggtcagaacattcacygaa

SEQ ID NO: 1678 - DNA, 23 bp, Artificial Sequence
  Synthetic Polynucleotide
tgcraacactccccattcgatgg

SEQ ID NO: 1679 - DNA, 23 bp, Artificial Sequence
  Synthetic Polynucleotide
tccatccrccgattccaggaggg

SEQ ID NO: 1680 - DNA, 23 bp, Artificial Sequence
  Synthetic Polynucleotide
gtccatccrccgattccaggagg

SEQ ID NO: 1681 - DNA, 23 bp, Artificial Sequence
  Synthetic Polynucleotide
cccgtgcccccgctgyagcagac

SEQ ID NO: 1682 - DNA, 23 bp, Artificial Sequence
  Synthetic Polynucleotide
ccgtgcccccgctgyagcagacc

SEQ ID NO: 1683 - DNA, 23 bp, Artificial Sequence
  Synthetic Polynucleotide
ccacttagcctcctyggcagaaa

SEQ ID NO: 1684 - DNA, 23 bp, Artificial Sequence
  Synthetic Polynucleotide
ccctgaagcagagaccaygattt

SEQ ID NO: 1685 - DNA, 23 bp, Artificial Sequence
  Synthetic Polynucleotide
cctgaagcagagaccaygatttg

SEQ ID NO: 1686 - DNA, 23 bp, Artificial Sequence
  Synthetic Polynucleotide
taaactrgctacttttcaattgg

SEQ ID NO: 1687 - DNA, 23 bp, Artificial Sequence
  Synthetic Polynucleotide
taaacacrgggtcagtcggacgg

SEQ ID NO: 1688 - DNA, 23 bp, Artificial Sequence
  Synthetic Polynucleotide
cccacaagcaatccaggaaygac

SEQ ID NO: 1689 - DNA, 23 bp, Artificial Sequence
  Synthetic Polynucleotide
ccacaagcaatccaggaaygact

SEQ ID NO: 1690 - DNA, 23 bp, Artificial Sequence
  Synthetic Polynucleotide
ccccagaaacatgcagyagtctc

SEQ ID NO: 1691 - DNA, 23 bp, Artificial Sequence
  Synthetic Polynucleotide
cccagaaacatgcagyagtctcg

SEQ ID NO: 1692 - DNA, 23 bp, Artificial Sequence
  Synthetic Polynucleotide
ccagaaacatgcagyagtctcgt

SEQ ID NO: 1693 - DNA, 23 bp, Artificial Sequence
  Synthetic Polynucleotide
cctggataaagctgtgctayagt

SEQ ID NO: 1694 - DNA, 23 bp, Artificial Sequence
  Synthetic Polynucleotide
cctgttgtcaataaaygaaatgg

SEQ ID NO: 1695 - DNA, 23 bp, Artificial Sequence
  Synthetic Polynucleotide
tgccccctrggctcgattatggg

SEQ ID NO: 1696 - DNA, 23 bp, Artificial Sequence
  Synthetic Polynucleotide
cccctgccccctgggctygatta

SEQ ID NO: 1697 - DNA, 23 bp, Artificial Sequence
  Synthetic Polynucleotide
ccctgccccctgggctygattat

SEQ ID NO: 1698 - DNA, 23 bp, Artificial Sequence
  Synthetic Polynucleotide
cctgccccctgggctygattatg

SEQ ID NO: 1699 - DNA, 23 bp, Artificial Sequence
  Synthetic Polynucleotide
cctgaggaccaagaacytgagga

SEQ ID NO: 1700 - DNA, 23 bp, Artificial Sequence
  Synthetic Polynucleotide
ccaggatattgtgaatyaagttc

SEQ ID NO: 1701 - DNA, 23 bp, Artificial Sequence
  Synthetic Polynucleotide
atgtggrgtctcattgctcaggg

SEQ ID NO: 1702 - DNA, 23 bp, Artificial Sequence
  Synthetic Polynucleotide
tatgtggrgtctcattgctcagg

SEQ ID NO: 1703 - DNA, 23 bp, Artificial Sequence
  Synthetic Polynucleotide
cctaattraagatgtcaagatgg

SEQ ID NO: 1704 - DNA, 23 bp, Artificial Sequence
  Synthetic Polynucleotide
ccaagatgacgataaaccyaatt

SEQ ID NO: 1705 - DNA, 23 bp, Artificial Sequence
  Synthetic Polynucleotide
cctgctgctcatcaycgagatca

SEQ ID NO: 1706 - DNA, 23 bp, Artificial Sequence
  Synthetic Polynucleotide
tactrtgttcctgctgctgctgg

SEQ ID NO: 1707 - DNA, 23 bp, Artificial Sequence
  Synthetic Polynucleotide
cctgcggcccgcggaaygagact

SEQ ID NO: 1708 - DNA, 23 bp, Artificial Sequence
  Synthetic Polynucleotide
ccatgcatgggggcyaggggccg

SEQ ID NO: 1709 - DNA, 23 bp, Artificial Sequence
  Synthetic Polynucleotide
gctacraggacgtggcacgcggg

SEQ ID NO: 1710 - DNA, 23 bp, Artificial Sequence
  Synthetic Polynucleotide
cgctacraggacgtggcacgcgg

SEQ ID NO: 1711 - DNA, 23 bp, Artificial Sequence
  Synthetic Polynucleotide
cgtggrgaaagaggtaggcctgg

SEQ ID NO: 1712 - DNA, 23 bp, Artificial Sequence
  Synthetic Polynucleotide
tgtttcragtgctggcagtgtgg

SEQ ID NO: 1713 - DNA, 23 bp, Artificial Sequence
  Synthetic Polynucleotide
ccagttctggatgtycatcgtgg

SEQ ID NO: 1714 - DNA, 23 bp, Artificial Sequence
  Synthetic Polynucleotide
ccccagagacccctgtgcyatct

SEQ ID NO: 1715 - DNA, 23 bp, Artificial Sequence
  Synthetic Polynucleotide
cccagagacccctgtgcyatctc

SEQ ID NO: 1716 - DNA, 23 bp, Artificial Sequence
  Synthetic Polynucleotide
ccagagacccctgtgcyatctcc

SEQ ID NO: 1717 - DNA, 23 bp, Artificial Sequence
  Synthetic Polynucleotide
ccaccactatgcccatacyctgc

SEQ ID NO: 1718 - DNA, 23 bp, Artificial Sequence
  Synthetic Polynucleotide
ccactatgcccatacyctgcgga

SEQ ID NO: 1719 - DNA, 23 bp, Artificial Sequence
  Synthetic Polynucleotide
ccgtactggtggcggcccyagcc

SEQ ID NO: 1720 - DNA, 23 bp, Artificial Sequence
  Synthetic Polynucleotide
gttgrggctgcagcctgcttagg

SEQ ID NO: 1721 - DNA, 23 bp, Artificial Sequence
  Synthetic Polynucleotide
tgttccrggccctgggcctgcgg

SEQ ID NO: 1722 - DNA, 23 bp, Artificial Sequence
  Synthetic Polynucleotide
cctgatgggagctgctgccyagc

SEQ ID NO: 1723 - DNA, 23 bp, Artificial Sequence
  Synthetic Polynucleotide
ccgggccctgggcctgyggcacc

SEQ ID NO: 1724 - DNA, 23 bp, Artificial Sequence
  Synthetic Polynucleotide
ggcarcggcggcagtgggcgtgg

SEQ ID NO: 1725 - DNA, 23 bp, Artificial Sequence
  Synthetic Polynucleotide
ctgrgctcctggacaccaggtgg

SEQ ID NO: 1726 - DNA, 23 bp, Artificial Sequence
  Synthetic Polynucleotide
ttcctgrgctcctggacaccagg

SEQ ID NO: 1727 - DNA, 23 bp, Artificial Sequence
  Synthetic Polynucleotide
ccaaggttctggaatccyggagg

SEQ ID NO: 1728 - DNA, 23 bp, Artificial Sequence
  Synthetic Polynucleotide
ctcrgaatggctgggtctctggg

SEQ ID NO: 1729 - DNA, 23 bp, Artificial Sequence
  Synthetic Polynucleotide
gctcrgaatggctgggtctctgg

SEQ ID NO: 1730 - DNA, 23 bp, Artificial Sequence
  Synthetic Polynucleotide
tcagrtaccccaggaatcattgg

SEQ ID NO: 1731 - DNA, 23 bp, Artificial Sequence
  Synthetic Polynucleotide
tttgrttggtcctgttggctcgg

SEQ ID NO: 1732 - DNA, 23 bp, Artificial Sequence
  Synthetic Polynucleotide
ccctgagtcacgctyagcaatac

SEQ ID NO: 1733 - DNA, 23 bp, Artificial Sequence
  Synthetic Polynucleotide
catggrtgccagcatccacctgg

SEQ ID NO: 1734 - DNA, 23 bp, Artificial Sequence
  Synthetic Polynucleotide
ctgrtgagtggacatcagcatgg

SEQ ID NO: 1735 - DNA, 23 bp, Artificial Sequence
  Synthetic Polynucleotide
cccttccacctcgacytctggtt

SEQ ID NO: 1736 - DNA, 23 bp, Artificial Sequence
  Synthetic Polynucleotide
ccttccacctcgacytctggttc

SEQ ID NO: 1737 - DNA, 23 bp, Artificial Sequence
  Synthetic Polynucleotide
acatcaagrggagcaagtcgggg

SEQ ID NO: 1738 - DNA, 23 bp, Artificial Sequence
  Synthetic Polynucleotide
ggccrtggtggctgatgatgggg

SEQ ID NO: 1739 - DNA, 23 bp, Artificial Sequence
  Synthetic Polynucleotide
tggccrtggtggctgatgatggg

SEQ ID NO: 1740 - DNA, 23 bp, Artificial Sequence
  Synthetic Polynucleotide
ctggccrtggtggctgatgatgg

SEQ ID NO: 1741 - DNA, 23 bp, Artificial Sequence
  Synthetic Polynucleotide
ccgcctactgaagttttccyggc

SEQ ID NO: 1742 - DNA, 23 bp, Artificial Sequence
  Synthetic Polynucleotide
cctactgaagttttccyggctct

SEQ ID NO: 1743 - DNA, 23 bp, Artificial Sequence
  Synthetic Polynucleotide
cccagaagtgaggttcaacygcc

SEQ ID NO: 1744 - DNA, 23 bp, Artificial Sequence
  Synthetic Polynucleotide
ccagaagtgaggttcaacygcct

SEQ ID NO: 1745 - DNA, 23 bp, Artificial Sequence
  Synthetic Polynucleotide
ccaaggacttggagacgygggtt

SEQ ID NO: 1746 - DNA, 23 bp, Artificial Sequence
  Synthetic Polynucleotide
tcctrgtgggcatcctcccaggg

SEQ ID NO: 1747 - DNA, 23 bp, Artificial Sequence
  Synthetic Polynucleotide
atcctrgtgggcatcctcccagg

SEQ ID NO: 1748 - DNA, 23 bp, Artificial Sequence
  Synthetic Polynucleotide
ccttcaccragcacgagcggcgg

SEQ ID NO: 1749 - DNA, 23 bp, Artificial Sequence
  Synthetic Polynucleotide
cttcggaragatcgtgccccagg

SEQ ID NO: 1750 - DNA, 23 bp, Artificial Sequence
  Synthetic Polynucleotide
cctcctacagaggtctctyagtt

SEQ ID NO: 1751 - DNA, 23 bp, Artificial Sequence
  Synthetic Polynucleotide
cctacagaggtctctyagtttag

SEQ ID NO: 1752 - DNA, 23 bp, Artificial Sequence
  Synthetic Polynucleotide
tactrgggaggctctgggcctgg

SEQ ID NO: 1753 - DNA, 23 bp, Artificial Sequence
  Synthetic Polynucleotide
ccccagtccagccccgtgyaggc

SEQ ID NO: 1754 - DNA, 23 bp, Artificial Sequence
  Synthetic Polynucleotide
cccagtccagccccgtgyaggcc

SEQ ID NO: 1755 - DNA, 23 bp, Artificial Sequence
  Synthetic Polynucleotide
ccagtccagccccgtgyaggcca

SEQ ID NO: 1756 - DNA, 23 bp, Artificial Sequence
  Synthetic Polynucleotide
ccgagacaagtttgccyggctct

SEQ ID NO: 1757 - DNA, 23 bp, Artificial Sequence
  Synthetic Polynucleotide
ccctgrgcagaagggtgagatgg

SEQ ID NO: 1758 - DNA, 23 bp, Artificial Sequence
  Synthetic Polynucleotide
cccattggtccgccagggygccc

SEQ ID NO: 1759 - DNA, 23 bp, Artificial Sequence
  Synthetic Polynucleotide
ccattggtccgccagggygccca

SEQ ID NO: 1760 - DNA, 23 bp, Artificial Sequence
  Synthetic Polynucleotide
cctggttccgaggggygacaagg

SEQ ID NO: 1761 - DNA, 23 bp, Artificial Sequence
  Synthetic Polynucleotide
acaacgcratattgcagcacagg

SEQ ID NO: 1762 - DNA, 23 bp, Artificial Sequence
  Synthetic Polynucleotide
ccagrcccccagggtcctccagg

SEQ ID NO: 1763 - DNA, 23 bp, Artificial Sequence
  Synthetic Polynucleotide
cgtgrtgaggcagggcctcctgg

SEQ ID NO: 1764 - DNA, 23 bp, Artificial Sequence
  Synthetic Polynucleotide
cctggtcccccagggcctygagg

SEQ ID NO: 1765 - DNA, 23 bp, Artificial Sequence
  Synthetic Polynucleotide
gccaatrtaagtatcctgccagg

SEQ ID NO: 1766 - DNA, 23 bp, Artificial Sequence
  Synthetic Polynucleotide
agctgrtctgcctggtgccaagg

SEQ ID NO: 1767 - DNA, 23 bp, Artificial Sequence
  Synthetic Polynucleotide
cccgrtagccagggcgcccctgg

SEQ ID NO: 1768 - DNA, 23 bp, Artificial Sequence
  Synthetic Polynucleotide
gctgrtcttccagggcctaaggg

SEQ ID NO: 1769 - DNA, 23 bp, Artificial Sequence
  Synthetic Polynucleotide
agctgrtcttccagggcctaagg

SEQ ID NO: 1770 - DNA, 23 bp, Artificial Sequence
  Synthetic Polynucleotide
gctrgtccccctggccctgccgg

SEQ ID NO: 1771 - DNA, 23 bp, Artificial Sequence
  Synthetic Polynucleotide
gccrgacccgctggaccccctgg

SEQ ID NO: 1772 - DNA, 23 bp, Artificial Sequence
  Synthetic Polynucleotide
ccccctgrccccattgtgagtgg

SEQ ID NO: 1773 - DNA, 23 bp, Artificial Sequence
  Synthetic Polynucleotide
ccctrgtgaatctggacgtgagg

SEQ ID NO: 1774 - DNA, 23 bp, Artificial Sequence
  Synthetic Polynucleotide
cctrgacgagacggttctcctgg

SEQ ID NO: 1775 - DNA, 23 bp, Artificial Sequence
  Synthetic Polynucleotide
accrgccccgctggaccccctgg

SEQ ID NO: 1776 - DNA, 23 bp, Artificial Sequence
  Synthetic Polynucleotide
gctgrcaagagtggtgatcgtgg

SEQ ID NO: 1777 - DNA, 23 bp, Artificial Sequence
  Synthetic Polynucleotide
gtcrgccctgttggcgcccgtgg

SEQ ID NO: 1778 - DNA, 23 bp, Artificial Sequence
  Synthetic Polynucleotide
caargcccccgtggtgacaaggg

SEQ ID NO: 1779 - DNA, 23 bp, Artificial Sequence
  Synthetic Polynucleotide
ccaargcccccgtggtgacaagg

SEQ ID NO: 1780 - DNA, 23 bp, Artificial Sequence
  Synthetic Polynucleotide
cccrgccctcctggacctcctgg

SEQ ID NO: 1781 - DNA, 23 bp, Artificial Sequence
  Synthetic Polynucleotide
gaargttcccctggacgagacgg

SEQ ID NO: 1782 - DNA, 23 bp, Artificial Sequence
  Synthetic Polynucleotide
cgagrattgcccggaacagctgg

SEQ ID NO: 1783 - DNA, 23 bp, Artificial Sequence
  Synthetic Polynucleotide
gatgrtgccaagggagatgctgg

SEQ ID NO: 1784 - DNA, 23 bp, Artificial Sequence
  Synthetic Polynucleotide
tgccrggccccctgtgagtgtgg

SEQ ID NO: 1785 - DNA, 23 bp, Artificial Sequence
  Synthetic Polynucleotide
ccccctggtgaatctggaygtga

SEQ ID NO: 1786 - DNA, 23 bp, Artificial Sequence
  Synthetic Polynucleotide
cccctggtgaatctggaygtgag

SEQ ID NO: 1787 - DNA, 23 bp, Artificial Sequence
  Synthetic Polynucleotide
ccctggtgaatctggaygtgagg

SEQ ID NO: 1788 - DNA, 23 bp, Artificial Sequence
  Synthetic Polynucleotide
cctggtgaatctggaygtgaggt

SEQ ID NO: 1789 - DNA, 23 bp, Artificial Sequence
  Synthetic Polynucleotide
ccgaaggttcccctggaygagac

SEQ ID NO: 1790 - DNA, 23 bp, Artificial Sequence
  Synthetic Polynucleotide
cctgcctggtgagagaggtygcc

SEQ ID NO: 1791 - DNA, 23 bp, Artificial Sequence
  Synthetic Polynucleotide
cctggtgagagaggtygccctgg

SEQ ID NO: 1792 - DNA, 23 bp, Artificial Sequence
  Synthetic Polynucleotide
cctrgtctcagaggtgaaattgg

SEQ ID NO: 1793 - DNA, 23 bp, Artificial Sequence
  Synthetic Polynucleotide
gctgrtcctgctggtcctgctgg

SEQ ID NO: 1794 - DNA, 23 bp, Artificial Sequence
  Synthetic Polynucleotide
aacrgtgttgttggtcccacagg

SEQ ID NO: 1795 - DNA, 23 bp, Artificial Sequence
  Synthetic Polynucleotide
cctrgcactccaggtcctcaggg

SEQ ID NO: 1796 - DNA, 23 bp, Artificial Sequence
  Synthetic Polynucleotide
tcctrgcactccaggtcctcagg

SEQ ID NO: 1797 - DNA, 23 bp, Artificial Sequence
  Synthetic Polynucleotide
cctrgacctccaggtgtaagcgg

SEQ ID NO: 1798 - DNA, 23 bp, Artificial Sequence
  Synthetic Polynucleotide
cgtgrtcctcctggtgctgtggg

SEQ ID NO: 1799 - DNA, 23 bp, Artificial Sequence
  Synthetic Polynucleotide
ccgtgrtcctcctggtgctgtgg

SEQ ID NO: 1800 - DNA, 23 bp, Artificial Sequence
  Synthetic Polynucleotide
caggrtccccctggtcctccagg

SEQ ID NO: 1801 - DNA, 23 bp, Artificial Sequence
  Synthetic Polynucleotide
cagrgtcttcttggtgctcctgg

SEQ ID NO: 1802 - DNA, 23 bp, Artificial Sequence
  Synthetic Polynucleotide
tctgrccctcctggtccccctgg

SEQ ID NO: 1803 - DNA, 23 bp, Artificial Sequence
  Synthetic Polynucleotide
tttgrtctccctggtcctgctgg

SEQ ID NO: 1804 - DNA, 23 bp, Artificial Sequence
  Synthetic Polynucleotide
tagrgtgatcctggcaaaaacgg

SEQ ID NO: 1805 - DNA, 23 bp, Artificial Sequence
  Synthetic Polynucleotide
cctgrtagtcgtggtgcaagtgg

SEQ ID NO: 1806 - DNA, 23 bp, Artificial Sequence
  Synthetic Polynucleotide
caggrcccccctggtccccctgg

SEQ ID NO: 1807 - DNA, 23 bp, Artificial Sequence
  Synthetic Polynucleotide
gccrgtccccgtggtgaagtggg

SEQ ID NO: 1808 - DNA, 23 bp, Artificial Sequence
  Synthetic Polynucleotide
cgccrgtccccgtggtgaagtgg

SEQ ID NO: 1809 - DNA, 23 bp, Artificial Sequence
  Synthetic Polynucleotide
cctrgctcccctggccccgctgg

SEQ ID NO: 1810 - DNA, 23 bp, Artificial Sequence
  Synthetic Polynucleotide
aaargccctgagggagcccctgg

SEQ ID NO: 1811 - DNA, 23 bp, Artificial Sequence
  Synthetic Polynucleotide
aagggrtccgcctggtcctcagg

SEQ ID NO: 1812 - DNA, 23 bp, Artificial Sequence
  Synthetic Polynucleotide
ggcggrtgctcctggtgtgaagg

SEQ ID NO: 1813 - DNA, 23 bp, Artificial Sequence
  Synthetic Polynucleotide
gaargtccaccaggtccccaggg

SEQ ID NO: 1814 - DNA, 23 bp, Artificial Sequence
  Synthetic Polynucleotide
cgaargtccaccaggtccccagg

SEQ ID NO: 1815 - DNA, 23 bp, Artificial Sequence
  Synthetic Polynucleotide
cgcgrtttcccaggtcaagatgg

SEQ ID NO: 1816 - DNA, 23 bp, Artificial Sequence
  Synthetic Polynucleotide
gtcrgtccctctggcaaagatgg

SEQ ID NO: 1817 - DNA, 23 bp, Artificial Sequence
  Synthetic Polynucleotide
gaacrgatctccgggcccaatgg

SEQ ID NO: 1818 - DNA, 23 bp, Artificial Sequence
  Synthetic Polynucleotide
tgtgraagccggagccctgccgg

SEQ ID NO: 1819 - DNA, 23 bp, Artificial Sequence
  Synthetic Polynucleotide
cttccrtggacagcaggcgtagg

SEQ ID NO: 1820 - DNA, 23 bp, Artificial Sequence
  Synthetic Polynucleotide
ctgragtcaaggtgagtgtctgg

SEQ ID NO: 1821 - DNA, 23 bp, Artificial Sequence
  Synthetic Polynucleotide
cagrgtccccgtggcctccccgg

SEQ ID NO: 1822 - DNA, 23 bp, Artificial Sequence
  Synthetic Polynucleotide
ccagggcctccagggtcccygtg

SEQ ID NO: 1823 - DNA, 23 bp, Artificial Sequence
  Synthetic Polynucleotide
ccctggagctgctggcygcgttg

SEQ ID NO: 1824 - DNA, 23 bp, Artificial Sequence
  Synthetic Polynucleotide
cctggagctgctggcygcgttgg

SEQ ID NO: 1825 - DNA, 23 bp, Artificial Sequence
  Synthetic Polynucleotide
gagracggccaggacttcctggg

SEQ ID NO: 1826 - DNA, 23 bp, Artificial Sequence
  Synthetic Polynucleotide
cgagracggccaggacttcctgg

SEQ ID NO: 1827 - DNA, 23 bp, Artificial Sequence
  Synthetic Polynucleotide
cccrgacttccaggtatagctgg

SEQ ID NO: 1828 - DNA, 23 bp, Artificial Sequence
  Synthetic Polynucleotide
caggraaaccctggatcagatgg

SEQ ID NO: 1829 - DNA, 23 bp, Artificial Sequence
  Synthetic Polynucleotide
agargggctcctggtgagcgagg

SEQ ID NO: 1830 - DNA, 23 bp, Artificial Sequence
  Synthetic Polynucleotide
actrgccctccaggacctgctgg

SEQ ID NO: 1831 - DNA, 23 bp, Artificial Sequence
  Synthetic Polynucleotide
gccgrtgcacctggagctccagg

SEQ ID NO: 1832 - DNA, 23 bp, Artificial Sequence
  Synthetic Polynucleotide
cgtgragctgctggcatcaaagg

SEQ ID NO: 1833 - DNA, 23 bp, Artificial Sequence
  Synthetic Polynucleotide
ccctrgatcccctggtgctaagg

SEQ ID NO: 1834 - DNA, 23 bp, Artificial Sequence
  Synthetic Polynucleotide
gctgrccaaccaggagagaaggg

SEQ ID NO: 1835 - DNA, 23 bp, Artificial Sequence
  Synthetic Polynucleotide
tgctgrccaaccaggagagaagg

SEQ ID NO: 1836 - DNA, 23 bp, Artificial Sequence
  Synthetic Polynucleotide
actgragcacggggtcttgcagg

SEQ ID NO: 1837 - DNA, 23 bp, Artificial Sequence
  Synthetic Polynucleotide
cctrggccacctggtgctgctgg

SEQ ID NO: 1838 - DNA, 23 bp, Artificial Sequence
  Synthetic Polynucleotide
tagrgagctccaggcccacttgg

SEQ ID NO: 1839 - DNA, 23 bp, Artificial Sequence
  Synthetic Polynucleotide
cgtrgagctgctggcatcaaagg

SEQ ID NO: 1840 - DNA, 23 bp, Artificial Sequence
  Synthetic Polynucleotide
cctrgtacatctggtcatcctgg

SEQ ID NO: 1841 - DNA, 23 bp, Artificial Sequence
  Synthetic Polynucleotide
cttrggattgctgggatcactgg

SEQ ID NO: 1842 - DNA, 23 bp, Artificial Sequence
  Synthetic Polynucleotide
cgtgrtccccctggaccccaggg

SEQ ID NO: 1843 - DNA, 23 bp, Artificial Sequence
  Synthetic Polynucleotide
acgtgrtccccctggaccccagg

SEQ ID NO: 1844 - DNA, 23 bp, Artificial Sequence
  Synthetic Polynucleotide
cctgrtccccaaggtgtcaaagg

SEQ ID NO: 1845 - DNA, 23 bp, Artificial Sequence
  Synthetic Polynucleotide
cagrtcccattggaccaccaggg

SEQ ID NO: 1846 - DNA, 23 bp, Artificial Sequence
  Synthetic Polynucleotide
ccagrtcccattggaccaccagg

SEQ ID NO: 1847 - DNA, 23 bp, Artificial Sequence
  Synthetic Polynucleotide
gcargggccccaggacttagagg

SEQ ID NO: 1848 - DNA, 23 bp, Artificial Sequence
  Synthetic Polynucleotide
cctgrgttccgaggacctgctgg

SEQ ID NO: 1849 - DNA, 23 bp, Artificial Sequence
  Synthetic Polynucleotide
gatgracgaaatggagaaaaggg

SEQ ID NO: 1850 - DNA, 23 bp, Artificial Sequence
  Synthetic Polynucleotide
cgatgracgaaatggagaaaagg

SEQ ID NO: 1851 - DNA, 23 bp, Artificial Sequence
  Synthetic Polynucleotide
cagargtgaaagaggatctgagg

SEQ ID NO: 1852 - DNA, 23 bp, Artificial Sequence
  Synthetic Polynucleotide
cttrgaagtcctggtccaaaggg

SEQ ID NO: 1853 - DNA, 23 bp, Artificial Sequence
  Synthetic Polynucleotide
tcttrgaagtcctggtccaaagg

SEQ ID NO: 1854 - DNA, 23 bp, Artificial Sequence
  Synthetic Polynucleotide
caggrtccaaagggtgatgccgg

SEQ ID NO: 1855 - DNA, 23 bp, Artificial Sequence
  Synthetic Polynucleotide
taggrtcctcctggtccccaagg

SEQ ID NO: 1856 - DNA, 23 bp, Artificial Sequence
  Synthetic Polynucleotide
agtgracctcctggcaaagatgg

SEQ ID NO: 1857 - DNA, 23 bp, Artificial Sequence
  Synthetic Polynucleotide
aatrgtgcccctggacaaagagg

SEQ ID NO: 1858 - DNA, 23 bp, Artificial Sequence
  Synthetic Polynucleotide
ctgtaarttttgtcattttttgg

SEQ ID NO: 1859 - DNA, 23 bp, Artificial Sequence
  Synthetic Polynucleotide
cctrgacctcctggtgcccctgg

SEQ ID NO: 1860 - DNA, 23 bp, Artificial Sequence
  Synthetic Polynucleotide
gatgrgcccccaggtcctgcggg

SEQ ID NO: 1861 - DNA, 23 bp, Artificial Sequence
  Synthetic Polynucleotide
ggatgrgcccccaggtcctgcgg

SEQ ID NO: 1862 - DNA, 23 bp, Artificial Sequence
  Synthetic Polynucleotide
ccagrcatgccaggtcctagggg

SEQ ID NO: 1863 - DNA, 23 bp, Artificial Sequence
  Synthetic Polynucleotide
accagrcatgccaggtcctaggg

SEQ ID NO: 1864 - DNA, 23 bp, Artificial Sequence
  Synthetic Polynucleotide
caccagrcatgccaggtcctagg

SEQ ID NO: 1865 - DNA, 23 bp, Artificial Sequence
  Synthetic Polynucleotide
aggragctccaggcccacttggg

SEQ ID NO: 1866 - DNA, 23 bp, Artificial Sequence
  Synthetic Polynucleotide
taggragctccaggcccacttgg

SEQ ID NO: 1867 - DNA, 23 bp, Artificial Sequence
  Synthetic Polynucleotide
ggagrccctcctggagttgcagg

SEQ ID NO: 1868 - DNA, 23 bp, Artificial Sequence
  Synthetic Polynucleotide
atcrgcagtccaggacctgcagg

SEQ ID NO: 1869 - DNA, 23 bp, Artificial Sequence
  Synthetic Polynucleotide
tgtaartatcatagttgagaggg

SEQ ID NO: 1870 - DNA, 23 bp, Artificial Sequence
  Synthetic Polynucleotide
ctgtaartatcatagttgagagg

SEQ ID NO: 1871 - DNA, 23 bp, Artificial Sequence
  Synthetic Polynucleotide
gtcgrtccagctggaaagagtgg

SEQ ID NO: 1872 - DNA, 23 bp, Artificial Sequence
  Synthetic Polynucleotide
cctrgagaaagaggaggtcttgg

SEQ ID NO: 1873 - DNA, 23 bp, Artificial Sequence
  Synthetic Polynucleotide
cctgrtcatccaggcccacctgg

SEQ ID NO: 1874 - DNA, 23 bp, Artificial Sequence
  Synthetic Polynucleotide
cctgrtgctgctggtactcctgg

SEQ ID NO: 1875 - DNA, 23 bp, Artificial Sequence
  Synthetic Polynucleotide
gctrgtgctcccggtcctgctgg

SEQ ID NO: 1876 - DNA, 23 bp, Artificial Sequence
  Synthetic Polynucleotide
cagrgccctccaggacctcctgg

SEQ ID NO: 1877 - DNA, 23 bp, Artificial Sequence
  Synthetic Polynucleotide
aaargacatcgaggattccctgg

SEQ ID NO: 1878 - DNA, 23 bp, Artificial Sequence
  Synthetic Polynucleotide
ccargcccacttgggattgctgg

SEQ ID NO: 1879 - DNA, 23 bp, Artificial Sequence
  Synthetic Polynucleotide
caggracacgctggtgctcaagg

SEQ ID NO: 1880 - DNA, 23 bp, Artificial Sequence
  Synthetic Polynucleotide
cctgraccccagggtcttcctgg

SEQ ID NO: 1881 - DNA, 23 bp, Artificial Sequence
  Synthetic Polynucleotide
aggrgaagccctggccctcaggg

SEQ ID NO: 1882 - DNA, 23 bp, Artificial Sequence
  Synthetic Polynucleotide
taggrgaagccctggccctcagg

SEQ ID NO: 1883 - DNA, 23 bp, Artificial Sequence
  Synthetic Polynucleotide
cctgrtctgcaaggaatgcctgg

SEQ ID NO: 1884 - DNA, 23 bp, Artificial Sequence
  Synthetic Polynucleotide
aacrgtctcagtggagaacgtgg

SEQ ID NO: 1885 - DNA, 23 bp, Artificial Sequence
  Synthetic Polynucleotide
cccrgaagtccaggaggaccagg

SEQ ID NO: 1886 - DNA, 23 bp, Artificial Sequence
  Synthetic Polynucleotide
aatgrtgctcctggactgcgagg

SEQ ID NO: 1887 - DNA, 23 bp, Artificial Sequence
  Synthetic Polynucleotide
agagrtggagctggtccccctgg

SEQ ID NO: 1888 - DNA, 23 bp, Artificial Sequence
  Synthetic Polynucleotide
aacagrtgctcctggattaaagg

SEQ ID NO: 1889 - DNA, 23 bp, Artificial Sequence
  Synthetic Polynucleotide
caggrtgaaagtgggaaaccagg

SEQ ID NO: 1890 - DNA, 23 bp, Artificial Sequence
  Synthetic Polynucleotide
ccagracctcctggtgctatagg

SEQ ID NO: 1891 - DNA, 23 bp, Artificial Sequence
  Synthetic Polynucleotide
ccagrcaaggatgggcccccagg

SEQ ID NO: 1892 - DNA, 23 bp, Artificial Sequence
  Synthetic Polynucleotide
ccargataccaaggaccccctgg

SEQ ID NO: 1893 - DNA, 23 bp, Artificial Sequence
  Synthetic Polynucleotide
agargaggtcttggaagtcctgg

SEQ ID NO: 1894 - DNA, 23 bp, Artificial Sequence
  Synthetic Polynucleotide
aaagrtgaaacaggtgaacgtgg

SEQ ID NO: 1895 - DNA, 23 bp, Artificial Sequence
  Synthetic Polynucleotide
acagraccccctggtccacaagg

SEQ ID NO: 1896 - DNA, 23 bp, Artificial Sequence
  Synthetic Polynucleotide
gctgrtattccaggtgttccagg

SEQ ID NO: 1897 - DNA, 23 bp, Artificial Sequence
  Synthetic Polynucleotide
cccrgacgacctggagagcgagg

SEQ ID NO: 1898 - DNA, 23 bp, Artificial Sequence
  Synthetic Polynucleotide
cctgrtgaacctgggcaagctgg

SEQ ID NO: 1899 - DNA, 23 bp, Artificial Sequence
  Synthetic Polynucleotide
actrgtcctattggtcctcctgg

SEQ ID NO: 1900 - DNA, 23 bp, Artificial Sequence
  Synthetic Polynucleotide
aatrgtgctcctggactgcgagg

SEQ ID NO: 1901 - DNA, 23 bp, Artificial Sequence
  Synthetic Polynucleotide
aaargcgaagatggcaaggatgg

SEQ ID NO: 1902 - DNA, 23 bp, Artificial Sequence
  Synthetic Polynucleotide
agctaaargcgaagatggcaagg

SEQ ID NO: 1903 - DNA, 23 bp, Artificial Sequence
  Synthetic Polynucleotide
ctgracctcagggacccccaggg

SEQ ID NO: 1904 - DNA, 23 bp, Artificial Sequence
  Synthetic Polynucleotide
actgracctcagggacccccagg

SEQ ID NO: 1905 - DNA, 23 bp, Artificial Sequence
  Synthetic Polynucleotide
ccargaccagccggtgctaatgg

SEQ ID NO: 1906 - DNA, 23 bp, Artificial Sequence
  Synthetic Polynucleotide
caargaatgcctggagaaagagg

SEQ ID NO: 1907 - DNA, 23 bp, Artificial Sequence
  Synthetic Polynucleotide
ccagrataccaaggaccccctgg

SEQ ID NO: 1908 - DNA, 23 bp, Artificial Sequence
  Synthetic Polynucleotide
aaagrtgaaggaggccctcctgg

SEQ ID NO: 1909 - DNA, 23 bp, Artificial Sequence
  Synthetic Polynucleotide
aaggrtgaaacaggtgctcctgg

SEQ ID NO: 1910 - DNA, 23 bp, Artificial Sequence
  Synthetic Polynucleotide
taggracctgttggacccagtgg

SEQ ID NO: 1911 - DNA, 23 bp, Artificial Sequence
  Synthetic Polynucleotide
gacrgtgctcgaggcagtgatgg

SEQ ID NO: 1912 - DNA, 23 bp, Artificial Sequence
  Synthetic Polynucleotide
tcagrtagacccggacgacctgg

SEQ ID NO: 1913 - DNA, 23 bp, Artificial Sequence
  Synthetic Polynucleotide
cctgragtgtctggaccaaaagg

SEQ ID NO: 1914 - DNA, 23 bp, Artificial Sequence
  Synthetic Polynucleotide
caagrcccacgtggtgacaaagg

SEQ ID NO: 1915 - DNA, 23 bp, Artificial Sequence
  Synthetic Polynucleotide
caggrccctcctggtcctcctgg

SEQ ID NO: 1916 - DNA, 23 bp, Artificial Sequence
  Synthetic Polynucleotide
actrgagcacggggtcttgcagg

SEQ ID NO: 1917 - DNA, 23 bp, Artificial Sequence
  Synthetic Polynucleotide
cctgrgccacctggtgctgctgg

SEQ ID NO: 1918 - DNA, 23 bp, Artificial Sequence
  Synthetic Polynucleotide
cctgragaaagaggaggtcttgg

SEQ ID NO: 1919 - DNA, 23 bp, Artificial Sequence
  Synthetic Polynucleotide
ccarggcaaccaggccctcctgg

SEQ ID NO: 1920 - DNA, 23 bp, Artificial Sequence
  Synthetic Polynucleotide
agagrtgaaactggccctccagg

SEQ ID NO: 1921 - DNA, 23 bp, Artificial Sequence
  Synthetic Polynucleotide
taggrtgctcctggtaagaatgg

SEQ ID NO: 1922 - DNA, 23 bp, Artificial Sequence
  Synthetic Polynucleotide
gccrgtgctaatggtgctcctgg

SEQ ID NO: 1923 - DNA, 23 bp, Artificial Sequence
  Synthetic Polynucleotide
agagragctgctggagaacctgg

SEQ ID NO: 1924 - DNA, 23 bp, Artificial Sequence
  Synthetic Polynucleotide
gctrgtcctcctgggccacctgg

SEQ ID NO: 1925 - DNA, 23 bp, Artificial Sequence
  Synthetic Polynucleotide
cctrgacaaagaggagaacctgg

SEQ ID NO: 1926 - DNA, 23 bp, Artificial Sequence
  Synthetic Polynucleotide
caagraatgcctggagaaagagg

SEQ ID NO: 1927 - DNA, 23 bp, Artificial Sequence
  Synthetic Polynucleotide
gctgrtccccctggtcccgaagg

SEQ ID NO: 1928 - DNA, 23 bp, Artificial Sequence
  Synthetic Polynucleotide
cctrgtgaacctgggcaagctgg

SEQ ID NO: 1929 - DNA, 23 bp, Artificial Sequence
  Synthetic Polynucleotide
ccagrccctcccggtccccctgg

SEQ ID NO: 1930 - DNA, 23 bp, Artificial Sequence
  Synthetic Polynucleotide
actgrtgctcctggcagccctgg

SEQ ID NO: 1931 - DNA, 23 bp, Artificial Sequence
  Synthetic Polynucleotide
tagrgcttcgatggacgaaatgg

SEQ ID NO: 1932 - DNA, 23 bp, Artificial Sequence
  Synthetic Polynucleotide
ccctrgccctcagggtgtcaagg

SEQ ID NO: 1933 - DNA, 23 bp, Artificial Sequence
  Synthetic Polynucleotide
cctgracctcctggtgcccctgg

SEQ ID NO: 1934 - DNA, 23 bp, Artificial Sequence
  Synthetic Polynucleotide
ccttcgacttctctccagcygag

SEQ ID NO: 1935 - DNA, 23 bp, Artificial Sequence
  Synthetic Polynucleotide
cctggtaagaatggagaaygagg

SEQ ID NO: 1936 - DNA, 23 bp, Artificial Sequence
  Synthetic Polynucleotide
cccrgggagaaggggagcattgg

SEQ ID NO: 1937 - DNA, 23 bp, Artificial Sequence
  Synthetic Polynucleotide
atgrggccaccggggactccagg

SEQ ID NO: 1938 - DNA, 23 bp, Artificial Sequence
  Synthetic Polynucleotide
cctgraagagatggccatccggg

SEQ ID NO: 1939 - DNA, 23 bp, Artificial Sequence
  Synthetic Polynucleotide
tcctgraagagatggccatccgg

SEQ ID NO: 1940 - DNA, 23 bp, Artificial Sequence
  Synthetic Polynucleotide
tttcarggagagcctggagttgg

SEQ ID NO: 1941 - DNA, 23 bp, Artificial Sequence
  Synthetic Polynucleotide
ccarggctgataggccagccagg

SEQ ID NO: 1942 - DNA, 23 bp, Artificial Sequence
  Synthetic Polynucleotide
cctggagragttggattcccagg

SEQ ID NO: 1943 - DNA, 23 bp, Artificial Sequence
  Synthetic Polynucleotide
aatgrcttacctgggaacccagg

SEQ ID NO: 1944 - DNA, 23 bp, Artificial Sequence
  Synthetic Polynucleotide
cccrgcattcctggcacacccgg

SEQ ID NO: 1945 - DNA, 23 bp, Artificial Sequence
  Synthetic Polynucleotide
cctgrtgtcaaaggagaagcagg

SEQ ID NO: 1946 - DNA, 23 bp, Artificial Sequence
  Synthetic Polynucleotide
aaargagaccgcggacctcaggg

SEQ ID NO: 1947 - DNA, 23 bp, Artificial Sequence
  Synthetic Polynucleotide
caaargagaccgcggacctcagg

SEQ ID NO: 1948 - DNA, 23 bp, Artificial Sequence
  Synthetic Polynucleotide
ccttgatcacctttaattcyctg

SEQ ID NO: 1949 - DNA, 23 bp, Artificial Sequence
  Synthetic Polynucleotide
cagrctttccagggctgactggg

SEQ ID NO: 1950 - DNA, 23 bp, Artificial Sequence
  Synthetic Polynucleotide
ccagrctttccagggctgactgg

SEQ ID NO: 1951 - DNA, 23 bp, Artificial Sequence
  Synthetic Polynucleotide
aaggragacatcggagtccccgg

SEQ ID NO: 1952 - DNA, 23 bp, Artificial Sequence
  Synthetic Polynucleotide
cctrgtccagtgggaatacctgg

SEQ ID NO: 1953 - DNA, 23 bp, Artificial Sequence
  Synthetic Polynucleotide
gatgrgctacctggtcctccagg

SEQ ID NO: 1954 - DNA, 23 bp, Artificial Sequence
  Synthetic Polynucleotide
attrggttgcctgggttgcctgg

SEQ ID NO: 1955 - DNA, 23 bp, Artificial Sequence
  Synthetic Polynucleotide
aggrgtcagaaaggtgatgaagg

SEQ ID NO: 1956 - DNA, 23 bp, Artificial Sequence
  Synthetic Polynucleotide
cctgracctcctggacttgacgg

SEQ ID NO: 1957 - DNA, 23 bp, Artificial Sequence
  Synthetic Polynucleotide
cctrggcttccagggcctcctgg

SEQ ID NO: 1958 - DNA, 23 bp, Artificial Sequence
  Synthetic Polynucleotide
cagrgagagagagggtttccagg

SEQ ID NO: 1959 - DNA, 23 bp, Artificial Sequence
  Synthetic Polynucleotide
caggrcattccaggagctccagg

SEQ ID NO: 1960 - DNA, 23 bp, Artificial Sequence
  Synthetic Polynucleotide
ccagragctccaggtgctccagg

SEQ ID NO: 1961 - DNA, 23 bp, Artificial Sequence
  Synthetic Polynucleotide
cctrgcactcctggacaggatgg

SEQ ID NO: 1962 - DNA, 23 bp, Artificial Sequence
  Synthetic Polynucleotide
tttacctrgcactcctggacagg

SEQ ID NO: 1963 - DNA, 23 bp, Artificial Sequence
  Synthetic Polynucleotide
gatrgattgccagggcttcctgg

SEQ ID NO: 1964 - DNA, 23 bp, Artificial Sequence
  Synthetic Polynucleotide
cagrcctcccagggaatataggg

SEQ ID NO: 1965 - DNA, 23 bp, Artificial Sequence
  Synthetic Polynucleotide
ccagrcctcccagggaatatagg

SEQ ID NO: 1966 - DNA, 23 bp, Artificial Sequence
  Synthetic Polynucleotide
aaagrcatacaaggtgtggcagg

SEQ ID NO: 1967 - DNA, 23 bp, Artificial Sequence
  Synthetic Polynucleotide
tgaaaaagrcatacaaggtgtgg

SEQ ID NO: 1968 - DNA, 23 bp, Artificial Sequence
  Synthetic Polynucleotide
ccagracttccaggtttcaaagg

SEQ ID NO: 1969 - DNA, 23 bp, Artificial Sequence
  Synthetic Polynucleotide
aaargagcacttggtccaaaagg

SEQ ID NO: 1970 - DNA, 23 bp, Artificial Sequence
  Synthetic Polynucleotide
ccagrgattcctgggccaatagg

SEQ ID NO: 1971 - DNA, 23 bp, Artificial Sequence
  Synthetic Polynucleotide
ccargacctttgggaattcctgg

SEQ ID NO: 1972 - DNA, 23 bp, Artificial Sequence
  Synthetic Polynucleotide
ttgrgaattcctggcaggagtgg

SEQ ID NO: 1973 - DNA, 23 bp, Artificial Sequence
  Synthetic Polynucleotide
gacctttgrgaattcctggcagg

SEQ ID NO: 1974 - DNA, 23 bp, Artificial Sequence
  Synthetic Polynucleotide
cctrgacttcctggatttccagg

SEQ ID NO: 1975 - DNA, 23 bp, Artificial Sequence
  Synthetic Polynucleotide
cctgracttccaggactttctgg

SEQ ID NO: 1976 - DNA, 23 bp, Artificial Sequence
  Synthetic Polynucleotide
tagrgagaacgtggatttccagg

SEQ ID NO: 1977 - DNA, 23 bp, Artificial Sequence
  Synthetic Polynucleotide
tcarggtaatcctggccggccgg

SEQ ID NO: 1978 - DNA, 23 bp, Artificial Sequence
  Synthetic Polynucleotide
ttattcarggtaatcctggccgg

SEQ ID NO: 1979 - DNA, 23 bp, Artificial Sequence
  Synthetic Polynucleotide
aaagragacccaggtctgccagg

SEQ ID NO: 1980 - DNA, 23 bp, Artificial Sequence
  Synthetic Polynucleotide
tccagtaarttataaaatttggg

SEQ ID NO: 1981 - DNA, 23 bp, Artificial Sequence
  Synthetic Polynucleotide
agtatgtraagctccagctgtgg

SEQ ID NO: 1982 - DNA, 23 bp, Artificial Sequence
  Synthetic Polynucleotide
caggrtgagcaaggtcttcaggg

SEQ ID NO: 1983 - DNA, 23 bp, Artificial Sequence
  Synthetic Polynucleotide
acaggrtgagcaaggtcttcagg

SEQ ID NO: 1984 - DNA, 23 bp, Artificial Sequence
  Synthetic Polynucleotide
tagrgtaaaccaggcaaagatgg

SEQ ID NO: 1985 - DNA, 23 bp, Artificial Sequence
  Synthetic Polynucleotide
ctgacargtcaaccaggctttgg

SEQ ID NO: 1986 - DNA, 23 bp, Artificial Sequence
  Synthetic Polynucleotide
gtargtccaactggccctccagg

SEQ ID NO: 1987 - DNA, 23 bp, Artificial Sequence
  Synthetic Polynucleotide
ccagrtttggaaggacacccagg

SEQ ID NO: 1988 - DNA, 23 bp, Artificial Sequence
  Synthetic Polynucleotide
cccagraccaccaggtttgatgg

SEQ ID NO: 1989 - DNA, 23 bp, Artificial Sequence
  Synthetic Polynucleotide
ccarggccaattggtcccccagg

SEQ ID NO: 1990 - DNA, 23 bp, Artificial Sequence
  Synthetic Polynucleotide
attgrtcccccaggaccaccagg

SEQ ID NO: 1991 - DNA, 23 bp, Artificial Sequence
  Synthetic Polynucleotide
cctgrtgaccgagggcctcctgg

SEQ ID NO: 1992 - DNA, 23 bp, Artificial Sequence
  Synthetic Polynucleotide
aatatgrgcttaaatttccaggg

SEQ ID NO: 1993 - DNA, 23 bp, Artificial Sequence
  Synthetic Polynucleotide
gaatatgrgcttaaatttccagg

SEQ ID NO: 1994 - DNA, 23 bp, Artificial Sequence
  Synthetic Polynucleotide
aagrgtttgcctggtgatcctgg

SEQ ID NO: 1995 - DNA, 23 bp, Artificial Sequence
  Synthetic Polynucleotide
cctgrttaccctggtgaacccgg

SEQ ID NO: 1996 - DNA, 23 bp, Artificial Sequence
  Synthetic Polynucleotide
acccgraagggatggtgaaaagg

SEQ ID NO: 1997 - DNA, 23 bp, Artificial Sequence
  Synthetic Polynucleotide
cctgrgttgcctggagaaaaagg

SEQ ID NO: 1998 - DNA, 23 bp, Artificial Sequence
  Synthetic Polynucleotide
aaagragagcgaggatttcctgg

SEQ ID NO: 1999 - DNA, 23 bp, Artificial Sequence
  Synthetic Polynucleotide
caggrtccacctggccttcctgg

SEQ ID NO: 2000 - DNA, 23 bp, Artificial Sequence
  Synthetic Polynucleotide
aaagrtgatgaaggaccacctgg

SEQ ID NO: 2001 - DNA, 23 bp, Artificial Sequence
  Synthetic Polynucleotide
ccacctrgaatttccattcctgg

SEQ ID NO: 2002 - DNA, 23 bp, Artificial Sequence
  Synthetic Polynucleotide
cctgrccttcctggacctccagg

SEQ ID NO: 2003 - DNA, 23 bp, Artificial Sequence
  Synthetic Polynucleotide
cctgratttcctggagaaagggg

SEQ ID NO: 2004 - DNA, 23 bp, Artificial Sequence
  Synthetic Polynucleotide
tcctgratttcctggagaaaggg

SEQ ID NO: 2005 - DNA, 23 bp, Artificial Sequence
  Synthetic Polynucleotide
ctcctgratttcctggagaaagg

SEQ ID NO: 2006 - DNA, 23 bp, Artificial Sequence
  Synthetic Polynucleotide
ctgracttgacggacagcctggg

SEQ ID NO: 2007 - DNA, 23 bp, Artificial Sequence
  Synthetic Polynucleotide
cctgracttgacggacagcctgg

SEQ ID NO: 2008 - DNA, 23 bp, Artificial Sequence
  Synthetic Polynucleotide
gacrgacagcctggggctcctgg

SEQ ID NO: 2009 - DNA, 23 bp, Artificial Sequence
  Synthetic Polynucleotide
ctgrggctcctgggcttccaggg

SEQ ID NO: 2010 - DNA, 23 bp, Artificial Sequence
  Synthetic Polynucleotide
cctgrggctcctgggcttccagg

SEQ ID NO: 2011 - DNA, 23 bp, Artificial Sequence
  Synthetic Polynucleotide
aaagractccaaggagaacaagg

SEQ ID NO: 2012 - DNA, 23 bp, Artificial Sequence
  Synthetic Polynucleotide
caagragaacaaggagtgaaagg

SEQ ID NO: 2013 - DNA, 23 bp, Artificial Sequence
  Synthetic Polynucleotide
tcagrgcctccaggtcaacctgg

SEQ ID NO: 2014 - DNA, 23 bp, Artificial Sequence
  Synthetic Polynucleotide
ccagrtcaacctggtttgccagg

SEQ ID NO: 2015 - DNA, 23 bp, Artificial Sequence
  Synthetic Polynucleotide
gctgrtgcaactggtcccaaagg

SEQ ID NO: 2016 - DNA, 23 bp, Artificial Sequence
  Synthetic Polynucleotide
ccagrtgctccaggctttcctgg

SEQ ID NO: 2017 - DNA, 23 bp, Artificial Sequence
  Synthetic Polynucleotide
ctgracaggatggattgccaggg

SEQ ID NO: 2018 - DNA, 23 bp, Artificial Sequence
  Synthetic Polynucleotide
cctgracaggatggattgccagg

SEQ ID NO: 2019 - DNA, 23 bp, Artificial Sequence
  Synthetic Polynucleotide
tagrgtggaattacttttaaggg

SEQ ID NO: 2020 - DNA, 23 bp, Artificial Sequence
  Synthetic Polynucleotide
ttagrgtggaattacttttaagg

SEQ ID NO: 2021 - DNA, 23 bp, Artificial Sequence
  Synthetic Polynucleotide
tagggtrgaattacttttaaggg

SEQ ID NO: 2022 - DNA, 23 bp, Artificial Sequence
  Synthetic Polynucleotide
ttagggtrgaattacttttaagg

SEQ ID NO: 2023 - DNA, 23 bp, Artificial Sequence
  Synthetic Polynucleotide
aaargagagttgggttcccctgg

SEQ ID NO: 2024 - DNA, 23 bp, Artificial Sequence
  Synthetic Polynucleotide
cctgrtttacctggcactcctgg

SEQ ID NO: 2025 - DNA, 23 bp, Artificial Sequence
  Synthetic Polynucleotide
cctrgacaggatggattgccagg

SEQ ID NO: 2026 - DNA, 23 bp, Artificial Sequence
  Synthetic Polynucleotide
ccccctgrtttcggccctccagg

SEQ ID NO: 2027 - DNA, 23 bp, Artificial Sequence
  Synthetic Polynucleotide
ccagrcccagtaggtgaaaaagg

SEQ ID NO: 2028 - DNA, 23 bp, Artificial Sequence
  Synthetic Polynucleotide
gtagrtgaaaaaggcatacaagg

SEQ ID NO: 2029 - DNA, 23 bp, Artificial Sequence
  Synthetic Polynucleotide
gtaggtraaaaaggcatacaagg

SEQ ID NO: 2030 - DNA, 23 bp, Artificial Sequence
  Synthetic Polynucleotide
caargtgtggcaggaaatccagg

SEQ ID NO: 2031 - DNA, 23 bp, Artificial Sequence
  Synthetic Polynucleotide
gatrgtgatgtaggtcttccagg

SEQ ID NO: 2032 - DNA, 23 bp, Artificial Sequence
  Synthetic Polynucleotide
tagrtgaccctggacttccaggg

SEQ ID NO: 2033 - DNA, 23 bp, Artificial Sequence
  Synthetic Polynucleotide
atagrtgaccctggacttccagg

SEQ ID NO: 2034 - DNA, 23 bp, Artificial Sequence
  Synthetic Polynucleotide
cagracctccaggagcacctggg

SEQ ID NO: 2035 - DNA, 23 bp, Artificial Sequence
  Synthetic Polynucleotide
ccagracctccaggagcacctgg

SEQ ID NO: 2036 - DNA, 23 bp, Artificial Sequence
  Synthetic Polynucleotide
cctgrgccacccggctttccagg

SEQ ID NO: 2037 - DNA, 23 bp, Artificial Sequence
  Synthetic Polynucleotide
acccgrctttccaggaccaaagg

SEQ ID NO: 2038 - DNA, 23 bp, Artificial Sequence
  Synthetic Polynucleotide
cagrgcaaccaggcttgccaggg

SEQ ID NO: 2039 - DNA, 23 bp, Artificial Sequence
  Synthetic Polynucleotide
ccagrgcaaccaggcttgccagg

SEQ ID NO: 2040 - DNA, 23 bp, Artificial Sequence
  Synthetic Polynucleotide
ccargacttccaggtttcaaagg

SEQ ID NO: 2041 - DNA, 23 bp, Artificial Sequence
  Synthetic Polynucleotide
ccagrtttcaaaggagcacttgg

SEQ ID NO: 2042 - DNA, 23 bp, Artificial Sequence
  Synthetic Polynucleotide
cgtrgtttcccaggacctccggg

SEQ ID NO: 2043 - DNA, 23 bp, Artificial Sequence
  Synthetic Polynucleotide
tcgtrgtttcccaggacctccgg

SEQ ID NO: 2044 - DNA, 23 bp, Artificial Sequence
  Synthetic Polynucleotide
ccctrgaccaaaaggtatggagg

SEQ ID NO: 2045 - DNA, 23 bp, Artificial Sequence
  Synthetic Polynucleotide
gctccctrgaccaaaaggtatgg

SEQ ID NO: 2046 - DNA, 23 bp, Artificial Sequence
  Synthetic Polynucleotide
gttrgaccaaatggacaacctgg

SEQ ID NO: 2047 - DNA, 23 bp, Artificial Sequence
  Synthetic Polynucleotide
ctgraccaatgggacctcctggg

SEQ ID NO: 2048 - DNA, 23 bp, Artificial Sequence
  Synthetic Polynucleotide
cctgraccaatgggacctcctgg

SEQ ID NO: 2049 - DNA, 23 bp, Artificial Sequence
  Synthetic Polynucleotide
atgrgacctcctgggctgccagg

SEQ ID NO: 2050 - DNA, 23 bp, Artificial Sequence
  Synthetic Polynucleotide
cctcctrgacttgatgttccagg

SEQ ID NO: 2051 - DNA, 23 bp, Artificial Sequence
  Synthetic Polynucleotide
cctcctgracttgatgttccagg

SEQ ID NO: 2052 - DNA, 23 bp, Artificial Sequence
  Synthetic Polynucleotide
ccagrgatccccggagcacctgg

SEQ ID NO: 2053 - DNA, 23 bp, Artificial Sequence
  Synthetic Polynucleotide
cccrgagcacctggtcctatagg

SEQ ID NO: 2054 - DNA, 23 bp, Artificial Sequence
  Synthetic Polynucleotide
tagracctccaggatcaccaggg

SEQ ID NO: 2055 - DNA, 23 bp, Artificial Sequence
  Synthetic Polynucleotide
atagracctccaggatcaccagg

SEQ ID NO: 2056 - DNA, 23 bp, Artificial Sequence
  Synthetic Polynucleotide
cctgrccctacaggagaaaaagg

SEQ ID NO: 2057 - DNA, 23 bp, Artificial Sequence
  Synthetic Polynucleotide
atcrgtgatatgggttttccagg

SEQ ID NO: 2058 - DNA, 23 bp, Artificial Sequence
  Synthetic Polynucleotide
cagrgtgtggaagggcctcctgg

SEQ ID NO: 2059 - DNA, 23 bp, Artificial Sequence
  Synthetic Polynucleotide
cctgraccttctggagttcctgg

SEQ ID NO: 2060 - DNA, 23 bp, Artificial Sequence
  Synthetic Polynucleotide
cagrgtgagcctggtctgcctgg

SEQ ID NO: 2061 - DNA, 23 bp, Artificial Sequence
  Synthetic Polynucleotide
cccrgattaccaggaacccctgg

SEQ ID NO: 2062 - DNA, 23 bp, Artificial Sequence
  Synthetic Polynucleotide
cccrgccttccaggagaacctgg

SEQ ID NO: 2063 - DNA, 23 bp, Artificial Sequence
  Synthetic Polynucleotide
cccgrccttccaggagaacctgg

SEQ ID NO: 2064 - DNA, 23 bp, Artificial Sequence
  Synthetic Polynucleotide
ctgrtctgcctggatacccaggg

SEQ ID NO: 2065 - DNA, 23 bp, Artificial Sequence
  Synthetic Polynucleotide
cctgrtctgcctggatacccagg

SEQ ID NO: 2066 - DNA, 23 bp, Artificial Sequence
  Synthetic Polynucleotide
ccarggcctccaggcgaaaaagg

SEQ ID NO: 2067 - DNA, 23 bp, Artificial Sequence
  Synthetic Polynucleotide
aaargcaaacccggtcaagatgg

SEQ ID NO: 2068 - DNA, 23 bp, Artificial Sequence
  Synthetic Polynucleotide
cccrgtcaagatggtattcctgg

SEQ ID NO: 2069 - DNA, 23 bp, Artificial Sequence
  Synthetic Polynucleotide
gctrgacagaagggtgaaccagg

SEQ ID NO: 2070 - DNA, 23 bp, Artificial Sequence
  Synthetic Polynucleotide
cctrgacttccaggactttctgg

SEQ ID NO: 2071 - DNA, 23 bp, Artificial Sequence
  Synthetic Polynucleotide
cctgrgattccaggaaatcctgg

SEQ ID NO: 2072 - DNA, 23 bp, Artificial Sequence
  Synthetic Polynucleotide
ccagraaatcctggccttccagg

SEQ ID NO: 2073 - DNA, 23 bp, Artificial Sequence
  Synthetic Polynucleotide
cctrgtgtgcagggtcccccagg

SEQ ID NO: 2074 - DNA, 23 bp, Artificial Sequence
  Synthetic Polynucleotide
ccagrtccaaagggcgaaccagg

SEQ ID NO: 2075 - DNA, 23 bp, Artificial Sequence
  Synthetic Polynucleotide
cacgrtttccctggtgtgcaggg

SEQ ID NO: 2076 - DNA, 23 bp, Artificial Sequence
  Synthetic Polynucleotide
tcacgrtttccctggtgtgcagg

SEQ ID NO: 2077 - DNA, 23 bp, Artificial Sequence
  Synthetic Polynucleotide
gaargtcctccaggtctccctgg

SEQ ID NO: 2078 - DNA, 23 bp, Artificial Sequence
  Synthetic Polynucleotide
tctccggrtccagctctggaagg

SEQ ID NO: 2079 - DNA, 23 bp, Artificial Sequence
  Synthetic Polynucleotide
aaargcaaccctgggccccaagg

SEQ ID NO: 2080 - DNA, 23 bp, Artificial Sequence
  Synthetic Polynucleotide
cctrggccccaaggtcctcctgg

SEQ ID NO: 2081 - DNA, 23 bp, Artificial Sequence
  Synthetic Polynucleotide
caargtcccccaggtccccctgg

SEQ ID NO: 2082 - DNA, 23 bp, Artificial Sequence
  Synthetic Polynucleotide
gattgrttattccttcatgatgg

SEQ ID NO: 2083 - DNA, 23 bp, Artificial Sequence
  Synthetic Polynucleotide
tccagrtaaattatgcctcaggg

SEQ ID NO: 2084 - DNA, 23 bp, Artificial Sequence
  Synthetic Polynucleotide
ctccagrtaaattatgcctcagg

SEQ ID NO: 2085 - DNA, 23 bp, Artificial Sequence
  Synthetic Polynucleotide
ttarggtggaattacttttaagg

SEQ ID NO: 2086 - DNA, 23 bp, Artificial Sequence
  Synthetic Polynucleotide
atggracctccaggcccaccagg

SEQ ID NO: 2087 - DNA, 23 bp, Artificial Sequence
  Synthetic Polynucleotide
ttggraattcctggcaggagtgg

SEQ ID NO: 2088 - DNA, 23 bp, Artificial Sequence
  Synthetic Polynucleotide
cctgrccttccaggccctcctgg

SEQ ID NO: 2089 - DNA, 23 bp, Artificial Sequence
  Synthetic Polynucleotide
ctargtcccaaaggtaaccctgg

SEQ ID NO: 2090 - DNA, 23 bp, Artificial Sequence
  Synthetic Polynucleotide
atargccaaaagggtgatggagg

SEQ ID NO: 2091 - DNA, 23 bp, Artificial Sequence
  Synthetic Polynucleotide
ttcatargccaaaagggtgatgg

SEQ ID NO: 2092 - DNA, 23 bp, Artificial Sequence
  Synthetic Polynucleotide
caagrtggagagaagggtattgg

SEQ ID NO: 2093 - DNA, 23 bp, Artificial Sequence
  Synthetic Polynucleotide
ccagrgaatatagggcctatggg

SEQ ID NO: 2094 - DNA, 23 bp, Artificial Sequence
  Synthetic Polynucleotide
cccagrgaatatagggcctatgg

SEQ ID NO: 2095 - DNA, 23 bp, Artificial Sequence
  Synthetic Polynucleotide
cctggcactcctggayaggatgg

SEQ ID NO: 2096 - DNA, 23 bp, Artificial Sequence
  Synthetic Polynucleotide
cccagggaatatagggcytatgg

SEQ ID NO: 2097 - DNA, 23 bp, Artificial Sequence
  Synthetic Polynucleotide
ccagggaatatagggcytatggg

SEQ ID NO: 2098 - DNA, 23 bp, Artificial Sequence
  Synthetic Polynucleotide
cctccaggaatccctggcyagcc

SEQ ID NO: 2099 - DNA, 23 bp, Artificial Sequence
  Synthetic Polynucleotide
ccaggaatccctggcyagcctgg

SEQ ID NO: 2100 - DNA, 23 bp, Artificial Sequence
  Synthetic Polynucleotide
cctggagaaaggggtyagaaagg

SEQ ID NO: 2101 - DNA, 23 bp, Artificial Sequence
  Synthetic Polynucleotide
cctggagaaaaaggagagygagg

SEQ ID NO: 2102 - DNA, 23 bp, Artificial Sequence
  Synthetic Polynucleotide
ccctggtctccctggayagccag

SEQ ID NO: 2103 - DNA, 23 bp, Artificial Sequence
  Synthetic Polynucleotide
cctggtctccctggayagccagg

SEQ ID NO: 2104 - DNA, 23 bp, Artificial Sequence
  Synthetic Polynucleotide
ccccaggattacctggayagaaa

SEQ ID NO: 2105 - DNA, 23 bp, Artificial Sequence
  Synthetic Polynucleotide
cccaggattacctggayagaaag

SEQ ID NO: 2106 - DNA, 23 bp, Artificial Sequence
  Synthetic Polynucleotide
ccaggattacctggayagaaagg

SEQ ID NO: 2107 - DNA, 23 bp, Artificial Sequence
  Synthetic Polynucleotide
cctggaccagctggayagaaggg

SEQ ID NO: 2108 - DNA, 23 bp, Artificial Sequence
  Synthetic Polynucleotide
ccctccaggagatcctggaygca

SEQ ID NO: 2109 - DNA, 23 bp, Artificial Sequence
  Synthetic Polynucleotide
cctccaggagatcctggaygcaa

SEQ ID NO: 2110 - DNA, 23 bp, Artificial Sequence
  Synthetic Polynucleotide
ccaggagatcctggaygcaatgg

SEQ ID NO: 2111 - DNA, 23 bp, Artificial Sequence
  Synthetic Polynucleotide
ccagccattcattagtyggtaag

SEQ ID NO: 2112 - DNA, 23 bp, Artificial Sequence
  Synthetic Polynucleotide
ggcrgcgatgcgggctccaaagg

SEQ ID NO: 2113 - DNA, 23 bp, Artificial Sequence
  Synthetic Polynucleotide
ccagrcctgccaggctgcaaggg

SEQ ID NO: 2114 - DNA, 23 bp, Artificial Sequence
  Synthetic Polynucleotide
cccagrcctgccaggctgcaagg

SEQ ID NO: 2115 - DNA, 23 bp, Artificial Sequence
  Synthetic Polynucleotide
aaggrcaacatgggtgagccggg

SEQ ID NO: 2116 - DNA, 23 bp, Artificial Sequence
  Synthetic Polynucleotide
caaggrcaacatgggtgagccgg

SEQ ID NO: 2117 - DNA, 23 bp, Artificial Sequence
  Synthetic Polynucleotide
aagrgcaacatgggtgagccggg

SEQ ID NO: 2118 - DNA, 23 bp, Artificial Sequence
  Synthetic Polynucleotide
caagrgcaacatgggtgagccgg

SEQ ID NO: 2119 - DNA, 23 bp, Artificial Sequence
  Synthetic Polynucleotide
caggragacccgggcatcgaagg

SEQ ID NO: 2120 - DNA, 23 bp, Artificial Sequence
  Synthetic Polynucleotide
gaargccccattggattcccagg

SEQ ID NO: 2121 - DNA, 23 bp, Artificial Sequence
  Synthetic Polynucleotide
atcracagctccgagagcattgg

SEQ ID NO: 2122 - DNA, 23 bp, Artificial Sequence
  Synthetic Polynucleotide
tcctccarggagaccccggcagg

SEQ ID NO: 2123 - DNA, 23 bp, Artificial Sequence
  Synthetic Polynucleotide
cctgctggacggctccgagyggc

SEQ ID NO: 2124 - DNA, 23 bp, Artificial Sequence
  Synthetic Polynucleotide
cccagaccttccctgcyaaacag

SEQ ID NO: 2125 - DNA, 23 bp, Artificial Sequence
  Synthetic Polynucleotide
ccagaccttccctgcyaaacagg

SEQ ID NO: 2126 - DNA, 23 bp, Artificial Sequence
  Synthetic Polynucleotide
ccatcgtgcgcagccygcgtggc

SEQ ID NO: 2127 - DNA, 23 bp, Artificial Sequence
  Synthetic Polynucleotide
aacgrcactcaaggtttccaggg

SEQ ID NO: 2128 - DNA, 23 bp, Artificial Sequence
  Synthetic Polynucleotide
gaacgrcactcaaggtttccagg

SEQ ID NO: 2129 - DNA, 23 bp, Artificial Sequence
  Synthetic Polynucleotide
aagrtgaggcgtgggtgatgggg

SEQ ID NO: 2130 - DNA, 23 bp, Artificial Sequence
  Synthetic Polynucleotide
aaagrtgaggcgtgggtgatggg

SEQ ID NO: 2131 - DNA, 23 bp, Artificial Sequence
  Synthetic Polynucleotide
taaagrtgaggcgtgggtgatgg

SEQ ID NO: 2132 - DNA, 23 bp, Artificial Sequence
  Synthetic Polynucleotide
ccaacttcaatgccatcygagac

SEQ ID NO: 2133 - DNA, 23 bp, Artificial Sequence
  Synthetic Polynucleotide
cctrgtattcccgggctcccagg

SEQ ID NO: 2134 - DNA, 23 bp, Artificial Sequence
  Synthetic Polynucleotide
cgcrggctgaagggcgaccgtgg

SEQ ID NO: 2135 - DNA, 23 bp, Artificial Sequence
  Synthetic Polynucleotide
cccrggctcccaggcagggctgg

SEQ ID NO: 2136 - DNA, 23 bp, Artificial Sequence
  Synthetic Polynucleotide
tattcccrggctcccaggcaggg

SEQ ID NO: 2137 - DNA, 23 bp, Artificial Sequence
  Synthetic Polynucleotide
gtattcccrggctcccaggcagg

SEQ ID NO: 2138 - DNA, 23 bp, Artificial Sequence
  Synthetic Polynucleotide
cagrggtctccaggtttgcctgg

SEQ ID NO: 2139 - DNA, 23 bp, Artificial Sequence
  Synthetic Polynucleotide
tccrgccttgccggggagcctgg

SEQ ID NO: 2140 - DNA, 23 bp, Artificial Sequence
  Synthetic Polynucleotide
gtcrgacctaaaggagaacctgg

SEQ ID NO: 2141 - DNA, 23 bp, Artificial Sequence
  Synthetic Polynucleotide
aaggrcgaccgtggagaccctgg

SEQ ID NO: 2142 - DNA, 23 bp, Artificial Sequence
  Synthetic Polynucleotide
ccctcaggrgccacctggtctgg

SEQ ID NO: 2143 - DNA, 23 bp, Artificial Sequence
  Synthetic Polynucleotide
gccrgggagcctggaaagcctgg

SEQ ID NO: 2144 - DNA, 23 bp, Artificial Sequence
  Synthetic Polynucleotide
ctgraaagcctggtattcccggg

SEQ ID NO: 2145 - DNA, 23 bp, Artificial Sequence
  Synthetic Polynucleotide
cctgraaagcctggtattcccgg

SEQ ID NO: 2146 - DNA, 23 bp, Artificial Sequence
  Synthetic Polynucleotide
gatgrccctcctggactccctgg

SEQ ID NO: 2147 - DNA, 23 bp, Artificial Sequence
  Synthetic Polynucleotide
cccrggctggcaggacacaaagg

SEQ ID NO: 2148 - DNA, 23 bp, Artificial Sequence
  Synthetic Polynucleotide
caggrgccaccaggacccactgg

SEQ ID NO: 2149 - DNA, 23 bp, Artificial Sequence
  Synthetic Polynucleotide
cccaggacctgttggccccygag

SEQ ID NO: 2150 - DNA, 23 bp, Artificial Sequence
  Synthetic Polynucleotide
ccaggacctgttggccccygagg

SEQ ID NO: 2151 - DNA, 23 bp, Artificial Sequence
  Synthetic Polynucleotide
cctacccctccagggtgacygag

SEQ ID NO: 2152 - DNA, 23 bp, Artificial Sequence
  Synthetic Polynucleotide
cccctccagggtgacygaggtcc

SEQ ID NO: 2153 - DNA, 23 bp, Artificial Sequence
  Synthetic Polynucleotide
ccctccagggtgacygaggtcct

SEQ ID NO: 2154 - DNA, 23 bp, Artificial Sequence
  Synthetic Polynucleotide
cttcatcrgcatcaacgacctgg

SEQ ID NO: 2155 - DNA, 23 bp, Artificial Sequence
  Synthetic Polynucleotide
catgcggrgtggccgcctggggg

SEQ ID NO: 2156 - DNA, 23 bp, Artificial Sequence
  Synthetic Polynucleotide
ccatgcggrgtggccgcctgggg

SEQ ID NO: 2157 - DNA, 23 bp, Artificial Sequence
  Synthetic Polynucleotide
catgcgggrtggccgcctggggg

SEQ ID NO: 2158 - DNA, 23 bp, Artificial Sequence
  Synthetic Polynucleotide
gccaatcrtccaatagccgctgg

SEQ ID NO: 2159 - DNA, 23 bp, Artificial Sequence
  Synthetic Polynucleotide
cctgtactatgagcggygctggg

SEQ ID NO: 2160 - DNA, 23 bp, Artificial Sequence
  Synthetic Polynucleotide
agcgtrtgggcattgtggcctgg

SEQ ID NO: 2161 - DNA, 23 bp, Artificial Sequence
  Synthetic Polynucleotide
cccatgacatccctygggtcagt

SEQ ID NO: 2162 - DNA, 23 bp, Artificial Sequence
  Synthetic Polynucleotide
ccartgaatatatctttagtggg

SEQ ID NO: 2163 - DNA, 23 bp, Artificial Sequence
  Synthetic Polynucleotide
cccartgaatatatctttagtgg

SEQ ID NO: 2164 - DNA, 23 bp, Artificial Sequence
  Synthetic Polynucleotide
ccccctgattgtttgtygaagac

SEQ ID NO: 2165 - DNA, 23 bp, Artificial Sequence
  Synthetic Polynucleotide
cccctgattgtttgtygaagacc

SEQ ID NO: 2166 - DNA, 23 bp, Artificial Sequence
  Synthetic Polynucleotide
ccctgattgtttgtygaagacct

SEQ ID NO: 2167 - DNA, 23 bp, Artificial Sequence
  Synthetic Polynucleotide
ttctattgrcatccactccacgg

SEQ ID NO: 2168 - DNA, 23 bp, Artificial Sequence
  Synthetic Polynucleotide
cccatcgtggagaayggcggggc

SEQ ID NO: 2169 - DNA, 23 bp, Artificial Sequence
  Synthetic Polynucleotide
ccccgcgcctggtccyagtgcgg

SEQ ID NO: 2170 - DNA, 23 bp, Artificial Sequence
  Synthetic Polynucleotide
cccgcgcctggtccyagtgcggc

SEQ ID NO: 2171 - DNA, 23 bp, Artificial Sequence
  Synthetic Polynucleotide
cagcgragggggctttggaccgg

SEQ ID NO: 2172 - DNA, 23 bp, Artificial Sequence
  Synthetic Polynucleotide
cagcggagrgggctttggaccgg

SEQ ID NO: 2173 - DNA, 23 bp, Artificial Sequence
  Synthetic Polynucleotide
ctgrgcagatgcgccgatcgtgg

SEQ ID NO: 2174 - DNA, 23 bp, Artificial Sequence
  Synthetic Polynucleotide
ccctcatcgtcaccatgygctac

SEQ ID NO: 2175 - DNA, 23 bp, Artificial Sequence
  Synthetic Polynucleotide
cctcatcgtcaccatgygctact

SEQ ID NO: 2176 - DNA, 23 bp, Artificial Sequence
  Synthetic Polynucleotide
cctgggcagatgcgcygatcgtg

SEQ ID NO: 2177 - DNA, 23 bp, Artificial Sequence
  Synthetic Polynucleotide
cctgaccagtgagaacygagaca

SEQ ID NO: 2178 - DNA, 23 bp, Artificial Sequence
  Synthetic Polynucleotide
ccgcactgagaccatcygcccgg

SEQ ID NO: 2179 - DNA, 23 bp, Artificial Sequence
  Synthetic Polynucleotide
ccatgtttgtccgaaygcttcaa

SEQ ID NO: 2180 - DNA, 23 bp, Artificial Sequence
  Synthetic Polynucleotide
ccgttgcgactgtgccyggcccc

SEQ ID NO: 2181 - DNA, 23 bp, Artificial Sequence
  Synthetic Polynucleotide
ccagcagccccgtgyagcagggc

SEQ ID NO: 2182 - DNA, 23 bp, Artificial Sequence
  Synthetic Polynucleotide
ccaggtgaccccgcagcctyaaa

SEQ ID NO: 2183 - DNA, 23 bp, Artificial Sequence
  Synthetic Polynucleotide
cctagaagcactgtatcgayagg

SEQ ID NO: 2184 - DNA, 23 bp, Artificial Sequence
  Synthetic Polynucleotide
ccggggaggtttttgtcygagtg

SEQ ID NO: 2185 - DNA, 23 bp, Artificial Sequence
  Synthetic Polynucleotide
ccatagcttaattaatyaggctt

SEQ ID NO: 2186 - DNA, 23 bp, Artificial Sequence
  Synthetic Polynucleotide
ccccttccccagcagyagcccat

SEQ ID NO: 2187 - DNA, 23 bp, Artificial Sequence
  Synthetic Polynucleotide
cccttccccagcagyagcccatg

SEQ ID NO: 2188 - DNA, 23 bp, Artificial Sequence
  Synthetic Polynucleotide
ttggccrtaagttggcacccagg

SEQ ID NO: 2189 - DNA, 23 bp, Artificial Sequence
  Synthetic Polynucleotide
ccccgcaggtggtatggcyagga

SEQ ID NO: 2190 - DNA, 23 bp, Artificial Sequence
  Synthetic Polynucleotide
cccgcaggtggtatggcyaggac

SEQ ID NO: 2191 - DNA, 23 bp, Artificial Sequence
  Synthetic Polynucleotide
ccgcaggtggtatggcyaggaca

SEQ ID NO: 2192 - DNA, 23 bp, Artificial Sequence
  Synthetic Polynucleotide
ccagtgcccccagagaaacycgt

SEQ ID NO: 2193 - DNA, 23 bp, Artificial Sequence
  Synthetic Polynucleotide
gatrgagccggggcgccgggggg

SEQ ID NO: 2194 - DNA, 23 bp, Artificial Sequence
  Synthetic Polynucleotide
cgatrgagccggggcgccggggg

SEQ ID NO: 2195 - DNA, 23 bp, Artificial Sequence
  Synthetic Polynucleotide
gcgatrgagccggggcgccgggg

SEQ ID NO: 2196 - DNA, 23 bp, Artificial Sequence
  Synthetic Polynucleotide
cgcgatrgagccggggcgccggg

SEQ ID NO: 2197 - DNA, 23 bp, Artificial Sequence
  Synthetic Polynucleotide
gcgcgatrgagccggggcgccgg

SEQ ID NO: 2198 - DNA, 23 bp, Artificial Sequence
  Synthetic Polynucleotide
cccccaggaagcagcggygggag

SEQ ID NO: 2199 - DNA, 23 bp, Artificial Sequence
  Synthetic Polynucleotide
ccccaggaagcagcggygggagc

SEQ ID NO: 2200 - DNA, 23 bp, Artificial Sequence
  Synthetic Polynucleotide
cccaggaagcagcggygggagcg

SEQ ID NO: 2201 - DNA, 23 bp, Artificial Sequence
  Synthetic Polynucleotide
ccaggaagcagcggygggagcgc

SEQ ID NO: 2202 - DNA, 23 bp, Artificial Sequence
  Synthetic Polynucleotide
ccaggtttggttcaagaacygga

SEQ ID NO: 2203 - DNA, 23 bp, Artificial Sequence
  Synthetic Polynucleotide
cctgrttcaagcgcaccctgggg

SEQ ID NO: 2204 - DNA, 23 bp, Artificial Sequence
  Synthetic Polynucleotide
ccctgrttcaagcgcaccctggg

SEQ ID NO: 2205 - DNA, 23 bp, Artificial Sequence
  Synthetic Polynucleotide
cccctgrttcaagcgcaccctgg

SEQ ID NO: 2206 - DNA, 23 bp, Artificial Sequence
  Synthetic Polynucleotide
ccgccagtccctcttcygcaccg

SEQ ID NO: 2207 - DNA, 23 bp, Artificial Sequence
  Synthetic Polynucleotide
ccagcacccctggttcaagygca

SEQ ID NO: 2208 - DNA, 23 bp, Artificial Sequence
  Synthetic Polynucleotide
cccgtgagttccacygccgctac

SEQ ID NO: 2209 - DNA, 23 bp, Artificial Sequence
  Synthetic Polynucleotide
ccatcagcccctactacygccag

SEQ ID NO: 2210 - DNA, 23 bp, Artificial Sequence
  Synthetic Polynucleotide
ccaccctccttcctgygggcacc

SEQ ID NO: 2211 - DNA, 23 bp, Artificial Sequence
  Synthetic Polynucleotide
gcctrtacccatggaggtaaggg

SEQ ID NO: 2212 - DNA, 23 bp, Artificial Sequence
  Synthetic Polynucleotide
agcctrtacccatggaggtaagg

SEQ ID NO: 2213 - DNA, 23 bp, Artificial Sequence
  Synthetic Polynucleotide
cgtaacrtgctgttgaccaatgg

SEQ ID NO: 2214 - DNA, 23 bp, Artificial Sequence
  Synthetic Polynucleotide
ccctcgragctggagcctttggg

SEQ ID NO: 2215 - DNA, 23 bp, Artificial Sequence
  Synthetic Polynucleotide
accctcgragctggagcctttgg

SEQ ID NO: 2216 - DNA, 23 bp, Artificial Sequence
  Synthetic Polynucleotide
ccctcagtgcatccacygggacg

SEQ ID NO: 2217 - DNA, 23 bp, Artificial Sequence
  Synthetic Polynucleotide
cctcagtgcatccacygggacgt

SEQ ID NO: 2218 - DNA, 23 bp, Artificial Sequence
  Synthetic Polynucleotide
cctgtgaagtggatggycccaga

SEQ ID NO: 2219 - DNA, 23 bp, Artificial Sequence
  Synthetic Polynucleotide
cctacaccctgcagataygctgc

SEQ ID NO: 2220 - DNA, 23 bp, Artificial Sequence
  Synthetic Polynucleotide
cctcaccctgatgaycttgaccc

SEQ ID NO: 2221 - DNA, 23 bp, Artificial Sequence
  Synthetic Polynucleotide
cccgcgrccggctccagtcccgg

SEQ ID NO: 2222 - DNA, 23 bp, Artificial Sequence
  Synthetic Polynucleotide
cacctrgctcttgaatgacacgg

SEQ ID NO: 2223 - DNA, 23 bp, Artificial Sequence
  Synthetic Polynucleotide
ccacrtgtccatcatcgtgcagg

SEQ ID NO: 2224 - DNA, 23 bp, Artificial Sequence
  Synthetic Polynucleotide
ccattctggtgccactaycacag

SEQ ID NO: 2225 - DNA, 23 bp, Artificial Sequence
  Synthetic Polynucleotide
ccgcagggtgaggctgaygttgg

SEQ ID NO: 2226 - DNA, 23 bp, Artificial Sequence
  Synthetic Polynucleotide
tcactgccrcccactgcatcagg

SEQ ID NO: 2227 - DNA, 23 bp, Artificial Sequence
  Synthetic Polynucleotide
ccggtagtctacaccygggtgtc

SEQ ID NO: 2228 - DNA, 23 bp, Artificial Sequence
  Synthetic Polynucleotide
ccccaatcctaagccctyaggag

SEQ ID NO: 2229 - DNA, 23 bp, Artificial Sequence
  Synthetic Polynucleotide
cccaatcctaagccctyaggagg

SEQ ID NO: 2230 - DNA, 23 bp, Artificial Sequence
  Synthetic Polynucleotide
ccaatcctaagccctyaggaggt

SEQ ID NO: 2231 - DNA, 23 bp, Artificial Sequence
  Synthetic Polynucleotide
ccaggacactgtgtyggtgagtc

SEQ ID NO: 2232 - DNA, 23 bp, Artificial Sequence
  Synthetic Polynucleotide
aaccrtctcagtcacactgaggg

SEQ ID NO: 2233 - DNA, 23 bp, Artificial Sequence
  Synthetic Polynucleotide
caaccrtctcagtcacactgagg

SEQ ID NO: 2234 - DNA, 23 bp, Artificial Sequence
  Synthetic Polynucleotide
ccaggaaaatcataaygttgtag

SEQ ID NO: 2235 - DNA, 23 bp, Artificial Sequence
  Synthetic Polynucleotide
cctctccaaaggaaagygaggtg

SEQ ID NO: 2236 - DNA, 23 bp, Artificial Sequence
  Synthetic Polynucleotide
cttcrtggacctggtcatcaagg

SEQ ID NO: 2237 - DNA, 23 bp, Artificial Sequence
  Synthetic Polynucleotide
gtcrgatggcgaacttccctggg

SEQ ID NO: 2238 - DNA, 23 bp, Artificial Sequence
  Synthetic Polynucleotide
ggtcrgatggcgaacttccctgg

SEQ ID NO: 2239 - DNA, 23 bp, Artificial Sequence
  Synthetic Polynucleotide
cccgttctgtcctgcaggcyagc

SEQ ID NO: 2240 - DNA, 23 bp, Artificial Sequence
  Synthetic Polynucleotide
ccgttctgtcctgcaggcyagca

SEQ ID NO: 2241 - DNA, 23 bp, Artificial Sequence
  Synthetic Polynucleotide
ccaagggattccgaccygaatca

SEQ ID NO: 2242 - DNA, 23 bp, Artificial Sequence
  Synthetic Polynucleotide
ttttrctcgaaagagaataaagg

SEQ ID NO: 2243 - DNA, 23 bp, Artificial Sequence
  Synthetic Polynucleotide
tccragaggtgcttcgcctcagg

SEQ ID NO: 2244 - DNA, 23 bp, Artificial Sequence
  Synthetic Polynucleotide
gggcrgcctcaaatggtaagtgg

SEQ ID NO: 2245 - DNA, 23 bp, Artificial Sequence
  Synthetic Polynucleotide
gctgcatcraaggctggcgatgg

SEQ ID NO: 2246 - DNA, 23 bp, Artificial Sequence
  Synthetic Polynucleotide
agcrtttcttgaatccagcgggg

SEQ ID NO: 2247 - DNA, 23 bp, Artificial Sequence
  Synthetic Polynucleotide
gagcrtttcttgaatccagcggg

SEQ ID NO: 2248 - DNA, 23 bp, Artificial Sequence
  Synthetic Polynucleotide
agagcrtttcttgaatccagcgg

SEQ ID NO: 2249 - DNA, 23 bp, Artificial Sequence
  Synthetic Polynucleotide
ccatccgagaggtgcttygcctc

SEQ ID NO: 2250 - DNA, 23 bp, Artificial Sequence
  Synthetic Polynucleotide
cccagctcatctcacygtcagta

SEQ ID NO: 2251 - DNA, 23 bp, Artificial Sequence
  Synthetic Polynucleotide
ccagctcatctcacygtcagtaa

SEQ ID NO: 2252 - DNA, 23 bp, Artificial Sequence
  Synthetic Polynucleotide
ccaactatcagtgacygtaaccg

SEQ ID NO: 2253 - DNA, 23 bp, Artificial Sequence
  Synthetic Polynucleotide
atcgraaacgcggcggcggtggg

SEQ ID NO: 2254 - DNA, 23 bp, Artificial Sequence
  Synthetic Polynucleotide
gatcgraaacgcggcggcggtgg

SEQ ID NO: 2255 - DNA, 23 bp, Artificial Sequence
  Synthetic Polynucleotide
actgatcgraaacgcggcggcgg

SEQ ID NO: 2256 - DNA, 23 bp, Artificial Sequence
  Synthetic Polynucleotide
acgggcccrggggcgcggaccgg

SEQ ID NO: 2257 - DNA, 23 bp, Artificial Sequence
  Synthetic Polynucleotide
cccatacaaggcagayggtccct

SEQ ID NO: 2258 - DNA, 23 bp, Artificial Sequence
  Synthetic Polynucleotide
ccatacaaggcagayggtccctc

SEQ ID NO: 2259 - DNA, 23 bp, Artificial Sequence
  Synthetic Polynucleotide
gttctrgcctggtatgtgggggg

SEQ ID NO: 2260 - DNA, 23 bp, Artificial Sequence
  Synthetic Polynucleotide
agttctrgcctggtatgtggggg

SEQ ID NO: 2261 - DNA, 23 bp, Artificial Sequence
  Synthetic Polynucleotide
gagttctrgcctggtatgtgggg

SEQ ID NO: 2262 - DNA, 23 bp, Artificial Sequence
  Synthetic Polynucleotide
tgagttctrgcctggtatgtggg

SEQ ID NO: 2263 - DNA, 23 bp, Artificial Sequence
  Synthetic Polynucleotide
ccgaggtgctgcgcctgyggccc

SEQ ID NO: 2264 - DNA, 23 bp, Artificial Sequence
  Synthetic Polynucleotide
ccttcacgctgctgycctccggg

SEQ ID NO: 2265 - DNA, 23 bp, Artificial Sequence
  Synthetic Polynucleotide
ccggagcctccacctccygcctc

SEQ ID NO: 2266 - DNA, 23 bp, Artificial Sequence
  Synthetic Polynucleotide
ccagattcagcagcgactgyagg

SEQ ID NO: 2267 - DNA, 23 bp, Artificial Sequence
  Synthetic Polynucleotide
cacaragctccagctggctgcgg

SEQ ID NO: 2268 - DNA, 23 bp, Artificial Sequence
  Synthetic Polynucleotide
tccrggcctgcctgggccgcagg

SEQ ID NO: 2269 - DNA, 23 bp, Artificial Sequence
  Synthetic Polynucleotide
aaactcccrgatcatagaaaagg

SEQ ID NO: 2270 - DNA, 23 bp, Artificial Sequence
  Synthetic Polynucleotide
cacrtgagctggggcctgaaggg

SEQ ID NO: 2271 - DNA, 23 bp, Artificial Sequence
  Synthetic Polynucleotide
ccacrtgagctggggcctgaagg

SEQ ID NO: 2272 - DNA, 23 bp, Artificial Sequence
  Synthetic Polynucleotide
tacrgaacgacatggagctatgg

SEQ ID NO: 2273 - DNA, 23 bp, Artificial Sequence
  Synthetic Polynucleotide
ccactggtaccagctgcgcyagg

SEQ ID NO: 2274 - DNA, 23 bp, Artificial Sequence
  Synthetic Polynucleotide
ccatcgggttaatgttcyagaac

SEQ ID NO: 2275 - DNA, 23 bp, Artificial Sequence
  Synthetic Polynucleotide
ccctttggctatggggtcygggc

SEQ ID NO: 2276 - DNA, 23 bp, Artificial Sequence
  Synthetic Polynucleotide
cctttggctatggggtcygggcc

SEQ ID NO: 2277 - DNA, 23 bp, Artificial Sequence
  Synthetic Polynucleotide
cccatttggctctgtgycctttg

SEQ ID NO: 2278 - DNA, 23 bp, Artificial Sequence
  Synthetic Polynucleotide
ccatttggctctgtgycctttgg

SEQ ID NO: 2279 - DNA, 23 bp, Artificial Sequence
  Synthetic Polynucleotide
agcrctgcagcttctcgccctgg

SEQ ID NO: 2280 - DNA, 23 bp, Artificial Sequence
  Synthetic Polynucleotide
ccagacgctggtcaytctgtgtc

SEQ ID NO: 2281 - DNA, 23 bp, Artificial Sequence
  Synthetic Polynucleotide
ccccgaagtccagacagcaytcc

SEQ ID NO: 2282 - DNA, 23 bp, Artificial Sequence
  Synthetic Polynucleotide
cccgaagtccagacagcaytcca

SEQ ID NO: 2283 - DNA, 23 bp, Artificial Sequence
  Synthetic Polynucleotide
ccgaagtccagacagcaytccac

SEQ ID NO: 2284 - DNA, 23 bp, Artificial Sequence
  Synthetic Polynucleotide
ggtcrggccagtgcccatggtgg

SEQ ID NO: 2285 - DNA, 23 bp, Artificial Sequence
  Synthetic Polynucleotide
ctgggtcrggccagtgcccatgg

SEQ ID NO: 2286 - DNA, 23 bp, Artificial Sequence
  Synthetic Polynucleotide
aactgrtccttatacctgttggg

SEQ ID NO: 2287 - DNA, 23 bp, Artificial Sequence
  Synthetic Polynucleotide
aaactgrtccttatacctgttgg

SEQ ID NO: 2288 - DNA, 23 bp, Artificial Sequence
  Synthetic Polynucleotide
ttcrtccaagtaatggcatctgg

SEQ ID NO: 2289 - DNA, 23 bp, Artificial Sequence
  Synthetic Polynucleotide
cctttttccttctgttcytttat

SEQ ID NO: 2290 - DNA, 23 bp, Artificial Sequence
  Synthetic Polynucleotide
tatgatcrttttatagaagatgg

SEQ ID NO: 2291 - DNA, 23 bp, Artificial Sequence
  Synthetic Polynucleotide
ccggggactactgtgtgygaaag

SEQ ID NO: 2292 - DNA, 23 bp, Artificial Sequence
  Synthetic Polynucleotide
cctgtgactgttttgayggtgat

SEQ ID NO: 2293 - DNA, 23 bp, Artificial Sequence
  Synthetic Polynucleotide
ccttccggggacatgacytcatg

SEQ ID NO: 2294 - DNA, 23 bp, Artificial Sequence
  Synthetic Polynucleotide
ccttcccaaagtccttcygggga

SEQ ID NO: 2295 - DNA, 23 bp, Artificial Sequence
  Synthetic Polynucleotide
ctcrtggtgctctggaccgatgg

SEQ ID NO: 2296 - DNA, 23 bp, Artificial Sequence
  Synthetic Polynucleotide
attccacragcaaatgcaatggg

SEQ ID NO: 2297 - DNA, 23 bp, Artificial Sequence
  Synthetic Polynucleotide
aattccacragcaaatgcaatgg

SEQ ID NO: 2298 - DNA, 23 bp, Artificial Sequence
  Synthetic Polynucleotide
atgatrgaactgttcaaggcagg

SEQ ID NO: 2299 - DNA, 23 bp, Artificial Sequence
  Synthetic Polynucleotide
atgggraccgctacttcaagggg

SEQ ID NO: 2300 - DNA, 23 bp, Artificial Sequence
  Synthetic Polynucleotide
aatgggraccgctacttcaaggg

SEQ ID NO: 2301 - DNA, 23 bp, Artificial Sequence
  Synthetic Polynucleotide
caatgggraccgctacttcaagg

SEQ ID NO: 2302 - DNA, 23 bp, Artificial Sequence
  Synthetic Polynucleotide
aggaargtaatttaaatagtggg

SEQ ID NO: 2303 - DNA, 23 bp, Artificial Sequence
  Synthetic Polynucleotide
gaggaargtaatttaaatagtgg

SEQ ID NO: 2304 - DNA, 23 bp, Artificial Sequence
  Synthetic Polynucleotide
atgrggaccgctacttcaagggg

SEQ ID NO: 2305 - DNA, 23 bp, Artificial Sequence
  Synthetic Polynucleotide
aatgrggaccgctacttcaaggg

SEQ ID NO: 2306 - DNA, 23 bp, Artificial Sequence
  Synthetic Polynucleotide
caatgrggaccgctacttcaagg

SEQ ID NO: 2307 - DNA, 23 bp, Artificial Sequence
  Synthetic Polynucleotide
ccaraatgccgagtcatgaaggg

SEQ ID NO: 2308 - DNA, 23 bp, Artificial Sequence
  Synthetic Polynucleotide
cccaraatgccgagtcatgaagg

SEQ ID NO: 2309 - DNA, 23 bp, Artificial Sequence
  Synthetic Polynucleotide
ccgcagtggggtgaagcctygga

SEQ ID NO: 2310 - DNA, 23 bp, Artificial Sequence
  Synthetic Polynucleotide
cccactgtagcttctacygaacc

SEQ ID NO: 2311 - DNA, 23 bp, Artificial Sequence
  Synthetic Polynucleotide
ccactgtagcttctacygaacca

SEQ ID NO: 2312 - DNA, 23 bp, Artificial Sequence
  Synthetic Polynucleotide
ccgaaccagaaccttgyaggcac

SEQ ID NO: 2313 - DNA, 23 bp, Artificial Sequence
  Synthetic Polynucleotide
cctctgaccgttttygcagcttt

SEQ ID NO: 2314 - DNA, 23 bp, Artificial Sequence
  Synthetic Polynucleotide
cctgcctcagggagtgygttaca

SEQ ID NO: 2315 - DNA, 23 bp, Artificial Sequence
  Synthetic Polynucleotide
ccaatatgaaagcccccyagtcc

SEQ ID NO: 2316 - DNA, 23 bp, Artificial Sequence
  Synthetic Polynucleotide
ccttttgccccagaatgcygagt

SEQ ID NO: 2317 - DNA, 23 bp, Artificial Sequence
  Synthetic Polynucleotide
ccctggtcctatgcgcygaagca

SEQ ID NO: 2318 - DNA, 23 bp, Artificial Sequence
  Synthetic Polynucleotide
cctggtcctatgcgcygaagcaa

SEQ ID NO: 2319 - DNA, 23 bp, Artificial Sequence
  Synthetic Polynucleotide
ccagaagagcgagatcygagttt

SEQ ID NO: 2320 - DNA, 23 bp, Artificial Sequence
  Synthetic Polynucleotide
ccacaacatgctgctyctttgac

SEQ ID NO: 2321 - DNA, 23 bp, Artificial Sequence
  Synthetic Polynucleotide
ccgggcagtgctccctatcygct

SEQ ID NO: 2322 - DNA, 23 bp, Artificial Sequence
  Synthetic Polynucleotide
cctccaaagggtgtcygccacac

SEQ ID NO: 2323 - DNA, 23 bp, Artificial Sequence
  Synthetic Polynucleotide
cccttcaccagttcygctcagga

SEQ ID NO: 2324 - DNA, 23 bp, Artificial Sequence
  Synthetic Polynucleotide
cccaattttagtggytacagcag

SEQ ID NO: 2325 - DNA, 23 bp, Artificial Sequence
  Synthetic Polynucleotide
ccccrgccgcctgcaaggaaggg

SEQ ID NO: 2326 - DNA, 23 bp, Artificial Sequence
  Synthetic Polynucleotide
tccccrgccgcctgcaaggaagg

SEQ ID NO: 2327 - DNA, 23 bp, Artificial Sequence
  Synthetic Polynucleotide
cctacatggacagcccaygaaag

SEQ ID NO: 2328 - DNA, 23 bp, Artificial Sequence
  Synthetic Polynucleotide
gggagrtaagtggtctgtctggg

SEQ ID NO: 2329 - DNA, 23 bp, Artificial Sequence
  Synthetic Polynucleotide
ggggagrtaagtggtctgtctgg

SEQ ID NO: 2330 - DNA, 23 bp, Artificial Sequence
  Synthetic Polynucleotide
atgtgragattgccacctaccgg

SEQ ID NO: 2331 - DNA, 23 bp, Artificial Sequence
  Synthetic Polynucleotide
gggagagragagccggtgagggg

SEQ ID NO: 2332 - DNA, 23 bp, Artificial Sequence
  Synthetic Polynucleotide
agggagagragagccggtgaggg

SEQ ID NO: 2333 - DNA, 23 bp, Artificial Sequence
  Synthetic Polynucleotide
cccttttaggatcaatctcycca

SEQ ID NO: 2334 - DNA, 23 bp, Artificial Sequence
  Synthetic Polynucleotide
ccttttaggatcaatctcyccat

SEQ ID NO: 2335 - DNA, 23 bp, Artificial Sequence
  Synthetic Polynucleotide
ccagccagcgcgtgtcctyctac

SEQ ID NO: 2336 - DNA, 23 bp, Artificial Sequence
  Synthetic Polynucleotide
ccagcgcgtgtcctyctaccgcc

SEQ ID NO: 2337 - DNA, 23 bp, Artificial Sequence
  Synthetic Polynucleotide
cctggggaaccagacaygagtgc

SEQ ID NO: 2338 - DNA, 23 bp, Artificial Sequence
  Synthetic Polynucleotide
cctcagagaggagtgagaaytgg

SEQ ID NO: 2339 - DNA, 23 bp, Artificial Sequence
  Synthetic Polynucleotide
ccagcgccccaggcygaggaagg

SEQ ID NO: 2340 - DNA, 23 bp, Artificial Sequence
  Synthetic Polynucleotide
ccttctggtgtagcctcyagcgg

SEQ ID NO: 2341 - DNA, 23 bp, Artificial Sequence
  Synthetic Polynucleotide
agargtctgtgtacagtgacagg

SEQ ID NO: 2342 - DNA, 23 bp, Artificial Sequence
  Synthetic Polynucleotide
ggcgccccrggatcgtcgcctgg

SEQ ID NO: 2343 - DNA, 23 bp, Artificial Sequence
  Synthetic Polynucleotide
ggcrccccgggatcgtcgcctgg

SEQ ID NO: 2344 - DNA, 23 bp, Artificial Sequence
  Synthetic Polynucleotide
tctacrtgattgacttcttctgg

SEQ ID NO: 2345 - DNA, 23 bp, Artificial Sequence
  Synthetic Polynucleotide
ccaagactccacctataaygagg

SEQ ID NO: 2346 - DNA, 23 bp, Artificial Sequence
  Synthetic Polynucleotide
cctactgctgttcgccyccttca

SEQ ID NO: 2347 - DNA, 23 bp, Artificial Sequence
  Synthetic Polynucleotide
cagtcacrggctttcagtggtgg

SEQ ID NO: 2348 - DNA, 23 bp, Artificial Sequence
  Synthetic Polynucleotide
ccctagacccagagtcttcygcc

SEQ ID NO: 2349 - DNA, 23 bp, Artificial Sequence
  Synthetic Polynucleotide
cctagacccagagtcttcygcct

SEQ ID NO: 2350 - DNA, 23 bp, Artificial Sequence
  Synthetic Polynucleotide
aagacartgcagtaagttccggg

SEQ ID NO: 2351 - DNA, 23 bp, Artificial Sequence
  Synthetic Polynucleotide
aaagacartgcagtaagttccgg

SEQ ID NO: 2352 - DNA, 23 bp, Artificial Sequence
  Synthetic Polynucleotide
cccacagacagcacacytgccac

SEQ ID NO: 2353 - DNA, 23 bp, Artificial Sequence
  Synthetic Polynucleotide
ccacagacagcacacytgccacc

SEQ ID NO: 2354 - DNA, 23 bp, Artificial Sequence
  Synthetic Polynucleotide
tgtgttraaggaatggctggtgg

SEQ ID NO: 2355 - DNA, 23 bp, Artificial Sequence
  Synthetic Polynucleotide
gaatrtccccccaacttcaccgg

SEQ ID NO: 2356 - DNA, 23 bp, Artificial Sequence
  Synthetic Polynucleotide
gctttgrtgggaagaagtagagg

SEQ ID NO: 2357 - DNA, 23 bp, Artificial Sequence
  Synthetic Polynucleotide
tttgraatataatcctccactgg

SEQ ID NO: 2358 - DNA, 23 bp, Artificial Sequence
  Synthetic Polynucleotide
gaargtctatgccagaaaggagg

SEQ ID NO: 2359 - DNA, 23 bp, Artificial Sequence
  Synthetic Polynucleotide
gtggaargtctatgccagaaagg

SEQ ID NO: 2360 - DNA, 23 bp, Artificial Sequence
  Synthetic Polynucleotide
cctgaagrttggtaaatttctgg

SEQ ID NO: 2361 - DNA, 23 bp, Artificial Sequence
  Synthetic Polynucleotide
agcccagargtaattgaatgtgg

SEQ ID NO: 2362 - DNA, 23 bp, Artificial Sequence
  Synthetic Polynucleotide
ataatargggacgaacagggagg

SEQ ID NO: 2363 - DNA, 23 bp, Artificial Sequence
  Synthetic Polynucleotide
cctcttcagtgacctayaggatg

SEQ ID NO: 2364 - DNA, 23 bp, Artificial Sequence
  Synthetic Polynucleotide
cctcgaaggcctgacagggyaaa

SEQ ID NO: 2365 - DNA, 23 bp, Artificial Sequence
  Synthetic Polynucleotide
ccaagttttgcctcaayaagtga

SEQ ID NO: 2366 - DNA, 23 bp, Artificial Sequence
  Synthetic Polynucleotide
ccagctggttgagcattgtyaaa

SEQ ID NO: 2367 - DNA, 23 bp, Artificial Sequence
  Synthetic Polynucleotide
ccaggtattgggagatygatggg

SEQ ID NO: 2368 - DNA, 23 bp, Artificial Sequence
  Synthetic Polynucleotide
ccggctatcagatcttyaacctc

SEQ ID NO: 2369 - DNA, 23 bp, Artificial Sequence
  Synthetic Polynucleotide
ccatcaggacatgggtcyagcag

SEQ ID NO: 2370 - DNA, 23 bp, Artificial Sequence
  Synthetic Polynucleotide
ccagccaattttgagyagcgtct

SEQ ID NO: 2371 - DNA, 23 bp, Artificial Sequence
  Synthetic Polynucleotide
cctttgaaggaattggagyagtt

SEQ ID NO: 2372 - DNA, 23 bp, Artificial Sequence
  Synthetic Polynucleotide
ccagcagtcagccacacaaygac

SEQ ID NO: 2373 - DNA, 23 bp, Artificial Sequence
  Synthetic Polynucleotide
ccaaagacctccgcyagtggcag

SEQ ID NO: 2374 - DNA, 23 bp, Artificial Sequence
  Synthetic Polynucleotide
cctttgtgacctttggyaagtca

SEQ ID NO: 2375 - DNA, 23 bp, Artificial Sequence
  Synthetic Polynucleotide
ccaatttgtacatcygaactgga

SEQ ID NO: 2376 - DNA, 23 bp, Artificial Sequence
  Synthetic Polynucleotide
ccacgctttttgtgygacatcca

SEQ ID NO: 2377 - DNA, 23 bp, Artificial Sequence
  Synthetic Polynucleotide
gacagrtaggtggagtggtgagg

SEQ ID NO: 2378 - DNA, 23 bp, Artificial Sequence
  Synthetic Polynucleotide
ccccactcctctcccyagaaccg

SEQ ID NO: 2379 - DNA, 23 bp, Artificial Sequence
  Synthetic Polynucleotide
cccactcctctcccyagaaccga

SEQ ID NO: 2380 - DNA, 23 bp, Artificial Sequence
  Synthetic Polynucleotide
cgagcrgttcccatttgagctgg

SEQ ID NO: 2381 - DNA, 23 bp, Artificial Sequence
  Synthetic Polynucleotide
ccaaggccgtggaggtgyagaac

SEQ ID NO: 2382 - DNA, 23 bp, Artificial Sequence
  Synthetic Polynucleotide
cgtcrcttctgaagtgtgtgagg

SEQ ID NO: 2383 - DNA, 23 bp, Artificial Sequence
  Synthetic Polynucleotide
tccrgtacccccaggatctttgg

SEQ ID NO: 2384 - DNA, 23 bp, Artificial Sequence
  Synthetic Polynucleotide
ccctgaggctgagctcyggaaag

SEQ ID NO: 2385 - DNA, 23 bp, Artificial Sequence
  Synthetic Polynucleotide
cctgaggctgagctcyggaaagc

SEQ ID NO: 2386 - DNA, 23 bp, Artificial Sequence
  Synthetic Polynucleotide
ccactcragcctttatctgaggg

SEQ ID NO: 2387 - DNA, 23 bp, Artificial Sequence
  Synthetic Polynucleotide
gccactcragcctttatctgagg

SEQ ID NO: 2388 - DNA, 23 bp, Artificial Sequence
  Synthetic Polynucleotide
tgarcagcggcacacgggtccgg

SEQ ID NO: 2389 - DNA, 23 bp, Artificial Sequence
  Synthetic Polynucleotide
agatgtgarcagcggcacacggg

SEQ ID NO: 2390 - DNA, 23 bp, Artificial Sequence
  Synthetic Polynucleotide
ccttcaagattataagayaagaa

SEQ ID NO: 2391 - DNA, 23 bp, Artificial Sequence
  Synthetic Polynucleotide
gtgttcratgcagatgaaatagg

SEQ ID NO: 2392 - DNA, 23 bp, Artificial Sequence
  Synthetic Polynucleotide
tagtgcrgcaaaagcgcgcctgg

SEQ ID NO: 2393 - DNA, 23 bp, Artificial Sequence
  Synthetic Polynucleotide
gcccccrtggctcttcgggaggg

SEQ ID NO: 2394 - DNA, 23 bp, Artificial Sequence
  Synthetic Polynucleotide
cgcccccrtggctcttcgggagg

SEQ ID NO: 2395 - DNA, 23 bp, Artificial Sequence
  Synthetic Polynucleotide
cattgcrgaaagggcgccaaagg

SEQ ID NO: 2396 - DNA, 23 bp, Artificial Sequence
  Synthetic Polynucleotide
cctgtaaaacaagctyaagttca

SEQ ID NO: 2397 - DNA, 23 bp, Artificial Sequence
  Synthetic Polynucleotide
gagrtgaccagcggcggcggggg

SEQ ID NO: 2398 - DNA, 23 bp, Artificial Sequence
  Synthetic Polynucleotide
cgagrtgaccagcggcggcgggg

SEQ ID NO: 2399 - DNA, 23 bp, Artificial Sequence
  Synthetic Polynucleotide
acgagrtgaccagcggcggcggg

SEQ ID NO: 2400 - DNA, 23 bp, Artificial Sequence
  Synthetic Polynucleotide
tacgagrtgaccagcggcggcgg

SEQ ID NO: 2401 - DNA, 23 bp, Artificial Sequence
  Synthetic Polynucleotide
ctcrctccggatctcgctccggg

SEQ ID NO: 2402 - DNA, 23 bp, Artificial Sequence
  Synthetic Polynucleotide
tctcrctccggatctcgctccgg

SEQ ID NO: 2403 - DNA, 23 bp, Artificial Sequence
  Synthetic Polynucleotide
ccatcagtgtccctygagtccgc

SEQ ID NO: 2404 - DNA, 23 bp, Artificial Sequence
  Synthetic Polynucleotide
ccactgagcagcgaaggygagct

SEQ ID NO: 2405 - DNA, 23 bp, Artificial Sequence
  Synthetic Polynucleotide
aatcrggcttccctggcttgcgg

SEQ ID NO: 2406 - DNA, 23 bp, Artificial Sequence
  Synthetic Polynucleotide
tgaaraggatgctctcagctggg

SEQ ID NO: 2407 - DNA, 23 bp, Artificial Sequence
  Synthetic Polynucleotide
ttgaaraggatgctctcagctgg

SEQ ID NO: 2408 - DNA, 23 bp, Artificial Sequence
  Synthetic Polynucleotide
tagrtgccaaagatgtacaatgg

SEQ ID NO: 2409 - DNA, 23 bp, Artificial Sequence
  Synthetic Polynucleotide
cactgcrcacgatgtagtcatgg

SEQ ID NO: 2410 - DNA, 23 bp, Artificial Sequence
  Synthetic Polynucleotide
ctgrggtaacgtgaaacctgtgg

SEQ ID NO: 2411 - DNA, 23 bp, Artificial Sequence
  Synthetic Polynucleotide
cccrtgagttctcaccactttgg

SEQ ID NO: 2412 - DNA, 23 bp, Artificial Sequence
  Synthetic Polynucleotide
gtgtgtacrtggatgggggctgg

SEQ ID NO: 2413 - DNA, 23 bp, Artificial Sequence
  Synthetic Polynucleotide
gcctrtgagtacatttccctggg

SEQ ID NO: 2414 - DNA, 23 bp, Artificial Sequence
  Synthetic Polynucleotide
cgcctrtgagtacatttccctgg

SEQ ID NO: 2415 - DNA, 23 bp, Artificial Sequence
  Synthetic Polynucleotide
tgagcracatttatgtgaaaggg

SEQ ID NO: 2416 - DNA, 23 bp, Artificial Sequence
  Synthetic Polynucleotide
atgagcracatttatgtgaaagg

SEQ ID NO: 2417 - DNA, 23 bp, Artificial Sequence
  Synthetic Polynucleotide
ccaaggtcccactcygagaggtc

SEQ ID NO: 2418 - DNA, 23 bp, Artificial Sequence
  Synthetic Polynucleotide
cctcttttgagctcatcyagaga

SEQ ID NO: 2419 - DNA, 23 bp, Artificial Sequence
  Synthetic Polynucleotide
ccctgcagctctggagyaggcgg

SEQ ID NO: 2420 - DNA, 23 bp, Artificial Sequence
  Synthetic Polynucleotide
cctgcagctctggagyaggcgga

SEQ ID NO: 2421 - DNA, 23 bp, Artificial Sequence
  Synthetic Polynucleotide
ccgtatctacattgtcygagcat

SEQ ID NO: 2422 - DNA, 23 bp, Artificial Sequence
  Synthetic Polynucleotide
tcggtrcaggaacatgagccagg

SEQ ID NO: 2423 - DNA, 23 bp, Artificial Sequence
  Synthetic Polynucleotide
ccccrgcgggggctctcatcagg

SEQ ID NO: 2424 - DNA, 23 bp, Artificial Sequence
  Synthetic Polynucleotide
tgtrgggaccactcagcctgtgg

SEQ ID NO: 2425 - DNA, 23 bp, Artificial Sequence
  Synthetic Polynucleotide
gccctgtrgctggtgctgcctgg

SEQ ID NO: 2426 - DNA, 23 bp, Artificial Sequence
  Synthetic Polynucleotide
cccacctgrcatatactggctgg

SEQ ID NO: 2427 - DNA, 23 bp, Artificial Sequence
  Synthetic Polynucleotide
cccattggggacttggcggygac

SEQ ID NO: 2428 - DNA, 23 bp, Artificial Sequence
  Synthetic Polynucleotide
ccattggggacttggcggygact

SEQ ID NO: 2429 - DNA, 23 bp, Artificial Sequence
  Synthetic Polynucleotide
ccaagggagacagcygatacatc

SEQ ID NO: 2430 - DNA, 23 bp, Artificial Sequence
  Synthetic Polynucleotide
ccagagagccatggycgccctgc

SEQ ID NO: 2431 - DNA, 23 bp, Artificial Sequence
  Synthetic Polynucleotide
ccagctggagagggagttcyagc

SEQ ID NO: 2432 - DNA, 23 bp, Artificial Sequence
  Synthetic Polynucleotide
cccctccccacccctatccygaa

SEQ ID NO: 2433 - DNA, 23 bp, Artificial Sequence
  Synthetic Polynucleotide
ccctccccacccctatccygaag

SEQ ID NO: 2434 - DNA, 23 bp, Artificial Sequence
  Synthetic Polynucleotide
cctccccacccctatccygaagc

SEQ ID NO: 2435 - DNA, 23 bp, Artificial Sequence
  Synthetic Polynucleotide
ccccacccctatccygaagcctc

SEQ ID NO: 2436 - DNA, 23 bp, Artificial Sequence
  Synthetic Polynucleotide
cagcrgggagctggaggtactgg

SEQ ID NO: 2437 - DNA, 23 bp, Artificial Sequence
  Synthetic Polynucleotide
ccagrtgagtcacctagtagggg

SEQ ID NO: 2438 - DNA, 23 bp, Artificial Sequence
  Synthetic Polynucleotide
accagrtgagtcacctagtaggg

SEQ ID NO: 2439 - DNA, 23 bp, Artificial Sequence
  Synthetic Polynucleotide
caccagrtgagtcacctagtagg

SEQ ID NO: 2440 - DNA, 23 bp, Artificial Sequence
  Synthetic Polynucleotide
ccgcgggagcgagggagcyaggg

SEQ ID NO: 2441 - DNA, 23 bp, Artificial Sequence
  Synthetic Polynucleotide
ccagggattcctggaattcyagg

SEQ ID NO: 2442 - DNA, 23 bp, Artificial Sequence
  Synthetic Polynucleotide
ccaggtcctcctggtcctyaagg

SEQ ID NO: 2443 - DNA, 23 bp, Artificial Sequence
  Synthetic Polynucleotide
aggcrtcacaaagactgtgaggg

SEQ ID NO: 2444 - DNA, 23 bp, Artificial Sequence
  Synthetic Polynucleotide
caggcrtcacaaagactgtgagg

SEQ ID NO: 2445 - DNA, 23 bp, Artificial Sequence
  Synthetic Polynucleotide
gattgagcrgctggatgctgtgg

SEQ ID NO: 2446 - DNA, 23 bp, Artificial Sequence
  Synthetic Polynucleotide
cctcgagaagactagcygaatgc

SEQ ID NO: 2447 - DNA, 23 bp, Artificial Sequence
  Synthetic Polynucleotide
ctatgacraattgtgcttcctgg

SEQ ID NO: 2448 - DNA, 23 bp, Artificial Sequence
  Synthetic Polynucleotide
ccacaaatgaatgcygggaggat

SEQ ID NO: 2449 - DNA, 23 bp, Artificial Sequence
  Synthetic Polynucleotide
ttctcctrccactgcccacaggg

SEQ ID NO: 2450 - DNA, 23 bp, Artificial Sequence
  Synthetic Polynucleotide
tttctcctrccactgcccacagg

SEQ ID NO: 2451 - DNA, 23 bp, Artificial Sequence
  Synthetic Polynucleotide
ccagctgctggccacaygcctct

SEQ ID NO: 2452 - DNA, 23 bp, Artificial Sequence
  Synthetic Polynucleotide
ccgccccttggagccayagccag

SEQ ID NO: 2453 - DNA, 23 bp, Artificial Sequence
  Synthetic Polynucleotide
ccgctctgacgagctgacayggc

SEQ ID NO: 2454 - DNA, 23 bp, Artificial Sequence
  Synthetic Polynucleotide
ccgcgcaagttagatygatttca

SEQ ID NO: 2455 - DNA, 23 bp, Artificial Sequence
  Synthetic Polynucleotide
cctcaaagaggctgccygaaaga

SEQ ID NO: 2456 - DNA, 23 bp, Artificial Sequence
  Synthetic Polynucleotide
gcggtttcrggtggtagtggtgg

SEQ ID NO: 2457 - DNA, 23 bp, Artificial Sequence
  Synthetic Polynucleotide
agagrtaagtacagaggaaaagg

SEQ ID NO: 2458 - DNA, 23 bp, Artificial Sequence
  Synthetic Polynucleotide
ccaatgcccggtgtattgycctg

SEQ ID NO: 2459 - DNA, 23 bp, Artificial Sequence
  Synthetic Polynucleotide
cccccagccacccaactygttgc

SEQ ID NO: 2460 - DNA, 23 bp, Artificial Sequence
  Synthetic Polynucleotide
ccccagccacccaactygttgcc

SEQ ID NO: 2461 - DNA, 23 bp, Artificial Sequence
  Synthetic Polynucleotide
cccagccacccaactygttgcca

SEQ ID NO: 2462 - DNA, 23 bp, Artificial Sequence
  Synthetic Polynucleotide
ccagccacccaactygttgccac

SEQ ID NO: 2463 - DNA, 23 bp, Artificial Sequence
  Synthetic Polynucleotide
ggaggagcrcagggagaagcggg

SEQ ID NO: 2464 - DNA, 23 bp, Artificial Sequence
  Synthetic Polynucleotide
ccgccacagctcaacgggtyggc

SEQ ID NO: 2465 - DNA, 23 bp, Artificial Sequence
  Synthetic Polynucleotide
ccacagctcaacgggtyggccac

SEQ ID NO: 2466 - DNA, 23 bp, Artificial Sequence
  Synthetic Polynucleotide
gtttgrtgagcactgggtggagg

SEQ ID NO: 2467 - DNA, 23 bp, Artificial Sequence
  Synthetic Polynucleotide
ccagtttgrtgagcactgggtgg

SEQ ID NO: 2468 - DNA, 23 bp, Artificial Sequence
  Synthetic Polynucleotide
ccttgtagccgaagctyaggcag

SEQ ID NO: 2469 - DNA, 23 bp, Artificial Sequence
  Synthetic Polynucleotide
ccacgcrggcagggattcccagg

SEQ ID NO: 2470 - DNA, 23 bp, Artificial Sequence
  Synthetic Polynucleotide
tgccaaatrtttggtgatgaagg

SEQ ID NO: 2471 - DNA, 23 bp, Artificial Sequence
  Synthetic Polynucleotide
ccagctgcgatgcccygcagcat

SEQ ID NO: 2472 - DNA, 23 bp, Artificial Sequence
  Synthetic Polynucleotide
gtggragctgatgacttttgggg

SEQ ID NO: 2473 - DNA, 23 bp, Artificial Sequence
  Synthetic Polynucleotide
tgtggragctgatgacttttggg

SEQ ID NO: 2474 - DNA, 23 bp, Artificial Sequence
  Synthetic Polynucleotide
gtgtggragctgatgacttttgg

SEQ ID NO: 2475 - DNA, 23 bp, Artificial Sequence
  Synthetic Polynucleotide
gccracaaggtgcagcttcaggg

SEQ ID NO: 2476 - DNA, 23 bp, Artificial Sequence
  Synthetic Polynucleotide
tgccracaaggtgcagcttcagg

SEQ ID NO: 2477 - DNA, 23 bp, Artificial Sequence
  Synthetic Polynucleotide
cctgcgcttctgcccacagyggt

SEQ ID NO: 2478 - DNA, 23 bp, Artificial Sequence
  Synthetic Polynucleotide
cctgcggcagatggcayagccct

SEQ ID NO: 2479 - DNA, 23 bp, Artificial Sequence
  Synthetic Polynucleotide
ccttcgatgccatgygccacgcg

SEQ ID NO: 2480 - DNA, 23 bp, Artificial Sequence
  Synthetic Polynucleotide
ccagtgcaccactacgggygggc

SEQ ID NO: 2481 - DNA, 23 bp, Artificial Sequence
  Synthetic Polynucleotide
ccaagtacttcctgyggcagatg

SEQ ID NO: 2482 - DNA, 23 bp, Artificial Sequence
  Synthetic Polynucleotide
cctgggaggccgagygagtcatg

SEQ ID NO: 2483 - DNA, 23 bp, Artificial Sequence
  Synthetic Polynucleotide
ccgatgcaaaataacctcygaga

SEQ ID NO: 2484 - DNA, 23 bp, Artificial Sequence
  Synthetic Polynucleotide
ccaagcactgtttggtagyaggt

SEQ ID NO: 2485 - DNA, 23 bp, Artificial Sequence
  Synthetic Polynucleotide
tgagcctcrgcccaggcggcggg

SEQ ID NO: 2486 - DNA, 23 bp, Artificial Sequence
  Synthetic Polynucleotide
tctrtggtggcgggggcggtggg

SEQ ID NO: 2487 - DNA, 23 bp, Artificial Sequence
  Synthetic Polynucleotide
atctrtggtggcgggggcggtgg

SEQ ID NO: 2488 - DNA, 23 bp, Artificial Sequence
  Synthetic Polynucleotide
ttgatctrtggtggcgggggcgg

SEQ ID NO: 2489 - DNA, 23 bp, Artificial Sequence
  Synthetic Polynucleotide
gcccrggacggtacccaaggagg

SEQ ID NO: 2490 - DNA, 23 bp, Artificial Sequence
  Synthetic Polynucleotide
ctggcccrggacggtacccaagg

SEQ ID NO: 2491 - DNA, 23 bp, Artificial Sequence
  Synthetic Polynucleotide
tcttrgtttttaaaatcattagg

SEQ ID NO: 2492 - DNA, 23 bp, Artificial Sequence
  Synthetic Polynucleotide
ccaaaaaataaaaccayaagtta

SEQ ID NO: 2493 - DNA, 23 bp, Artificial Sequence
  Synthetic Polynucleotide
ggcrgaaggtgggtggggcgggg

SEQ ID NO: 2494 - DNA, 23 bp, Artificial Sequence
  Synthetic Polynucleotide
aggcrgaaggtgggtggggcggg

SEQ ID NO: 2495 - DNA, 23 bp, Artificial Sequence
  Synthetic Polynucleotide
gaggcrgaaggtgggtggggcgg

SEQ ID NO: 2496 - DNA, 23 bp, Artificial Sequence
  Synthetic Polynucleotide
gcagaggcrgaaggtgggtgggg

SEQ ID NO: 2497 - DNA, 23 bp, Artificial Sequence
  Synthetic Polynucleotide
ccaaattcagataatygacgcca

SEQ ID NO: 2498 - DNA, 23 bp, Artificial Sequence
  Synthetic Polynucleotide
ctgccttcrgaaaggtgagaagg

SEQ ID NO: 2499 - DNA, 23 bp, Artificial Sequence
  Synthetic Polynucleotide
gtggagcrggagatcgatggggg

SEQ ID NO: 2500 - DNA, 23 bp, Artificial Sequence
  Synthetic Polynucleotide
agtggagcrggagatcgatgggg

SEQ ID NO: 2501 - DNA, 23 bp, Artificial Sequence
  Synthetic Polynucleotide
aactgrgtggtacctgaaggtgg

SEQ ID NO: 2502 - DNA, 23 bp, Artificial Sequence
  Synthetic Polynucleotide
attaactgrgtggtacctgaagg

SEQ ID NO: 2503 - DNA, 23 bp, Artificial Sequence
  Synthetic Polynucleotide
ttccrgatagtggatcccaacgg

SEQ ID NO: 2504 - DNA, 23 bp, Artificial Sequence
  Synthetic Polynucleotide
ccgccgcctctcccyggctgaga

SEQ ID NO: 2505 - DNA, 23 bp, Artificial Sequence
  Synthetic Polynucleotide
gtgtacggrgcggtgtggactgg

SEQ ID NO: 2506 - DNA, 23 bp, Artificial Sequence
  Synthetic Polynucleotide
cctgaggrccacccaaatgctgg

SEQ ID NO: 2507 - DNA, 23 bp, Artificial Sequence
  Synthetic Polynucleotide
ccttgtccactgggacttygact

SEQ ID NO: 2508 - DNA, 23 bp, Artificial Sequence
  Synthetic Polynucleotide
catctgacrtggcaggctggggg

SEQ ID NO: 2509 - DNA, 23 bp, Artificial Sequence
  Synthetic Polynucleotide
ccacraggaacagaactctgtgg

SEQ ID NO: 2510 - DNA, 23 bp, Artificial Sequence
  Synthetic Polynucleotide
cagccrtgtggggtctgcaatgg

SEQ ID NO: 2511 - DNA, 23 bp, Artificial Sequence
  Synthetic Polynucleotide
ccctatggcgtacttygaaccag

SEQ ID NO: 2512 - DNA, 23 bp, Artificial Sequence
  Synthetic Polynucleotide
cctatggcgtacttygaaccagt

SEQ ID NO: 2513 - DNA, 23 bp, Artificial Sequence
  Synthetic Polynucleotide
ccctgggtctctgggcatyggaa

SEQ ID NO: 2514 - DNA, 23 bp, Artificial Sequence
  Synthetic Polynucleotide
cctgggtctctgggcatyggaag

SEQ ID NO: 2515 - DNA, 23 bp, Artificial Sequence
  Synthetic Polynucleotide
cctttaaaagaaaccctgygaaa

SEQ ID NO: 2516 - DNA, 23 bp, Artificial Sequence
  Synthetic Polynucleotide
tcccrcaccaggtacagaactgg

SEQ ID NO: 2517 - DNA, 23 bp, Artificial Sequence
  Synthetic Polynucleotide
gttcragaagaagtcgctggagg

SEQ ID NO: 2518 - DNA, 23 bp, Artificial Sequence
  Synthetic Polynucleotide
tctgttcragaagaagtcgctgg

SEQ ID NO: 2519 - DNA, 23 bp, Artificial Sequence
  Synthetic Polynucleotide
caaaaccraaagagagctcctgg

SEQ ID NO: 2520 - DNA, 23 bp, Artificial Sequence
  Synthetic Polynucleotide
ttggaraaaaccagagagcaggg

SEQ ID NO: 2521 - DNA, 23 bp, Artificial Sequence
  Synthetic Polynucleotide
gttggaraaaaccagagagcagg

SEQ ID NO: 2522 - DNA, 23 bp, Artificial Sequence
  Synthetic Polynucleotide
ccgtggcgccacggycctggagc

SEQ ID NO: 2523 - DNA, 23 bp, Artificial Sequence
  Synthetic Polynucleotide
gtgragaggctctgggattatgg

SEQ ID NO: 2524 - DNA, 23 bp, Artificial Sequence
  Synthetic Polynucleotide
actcttcrcatggagttgatggg

SEQ ID NO: 2525 - DNA, 23 bp, Artificial Sequence
  Synthetic Polynucleotide
cactcttcrcatggagttgatgg

SEQ ID NO: 2526 - DNA, 23 bp, Artificial Sequence
  Synthetic Polynucleotide
tctttgatragaccaaaagctgg

SEQ ID NO: 2527 - DNA, 23 bp, Artificial Sequence
  Synthetic Polynucleotide
ccctccaattattgctygataca

SEQ ID NO: 2528 - DNA, 23 bp, Artificial Sequence
  Synthetic Polynucleotide
cctccaattattgctygatacat

SEQ ID NO: 2529 - DNA, 23 bp, Artificial Sequence
  Synthetic Polynucleotide
ccttcctttatccaaattygctc

SEQ ID NO: 2530 - DNA, 23 bp, Artificial Sequence
  Synthetic Polynucleotide
cctttatccaaattygctcagtt

SEQ ID NO: 2531 - DNA, 23 bp, Artificial Sequence
  Synthetic Polynucleotide
ccagaggaaccccaactaygaat

SEQ ID NO: 2532 - DNA, 23 bp, Artificial Sequence
  Synthetic Polynucleotide
cctgaaagagaatggtycaatgg

SEQ ID NO: 2533 - DNA, 23 bp, Artificial Sequence
  Synthetic Polynucleotide
cctcgaaggtcacayatttcttg

SEQ ID NO: 2534 - DNA, 23 bp, Artificial Sequence
  Synthetic Polynucleotide
ccaactaaatcagatcctyggtg

SEQ ID NO: 2535 - DNA, 23 bp, Artificial Sequence
  Synthetic Polynucleotide
cctcacagagaatatacaaygct

SEQ ID NO: 2536 - DNA, 23 bp, Artificial Sequence
  Synthetic Polynucleotide
ccacaactcagactttyggaaca

SEQ ID NO: 2537 - DNA, 23 bp, Artificial Sequence
  Synthetic Polynucleotide
ccttctattctagcyttatttct

SEQ ID NO: 2538 - DNA, 23 bp, Artificial Sequence
  Synthetic Polynucleotide
ccaaagctggaatttggygggtg

SEQ ID NO: 2539 - DNA, 23 bp, Artificial Sequence
  Synthetic Polynucleotide
ccaaggagcccttttyttggatc

SEQ ID NO: 2540 - DNA, 23 bp, Artificial Sequence
  Synthetic Polynucleotide
ccgtttgcacccaaytcattata

SEQ ID NO: 2541 - DNA, 23 bp, Artificial Sequence
  Synthetic Polynucleotide
cccaactcattatagcattygca

SEQ ID NO: 2542 - DNA, 23 bp, Artificial Sequence
  Synthetic Polynucleotide
ccaactcattatagcattygcag

SEQ ID NO: 2543 - DNA, 23 bp, Artificial Sequence
  Synthetic Polynucleotide
cccaccgttactgactygctacc

SEQ ID NO: 2544 - DNA, 23 bp, Artificial Sequence
  Synthetic Polynucleotide
ccaccgttactgactygctacct

SEQ ID NO: 2545 - DNA, 23 bp, Artificial Sequence
  Synthetic Polynucleotide
tggrgaagagtcttccacaaagg

SEQ ID NO: 2546 - DNA, 23 bp, Artificial Sequence
  Synthetic Polynucleotide
caaatatrgaatatataccaagg

SEQ ID NO: 2547 - DNA, 23 bp, Artificial Sequence
  Synthetic Polynucleotide
gggraagagtcttccacaaaggg

SEQ ID NO: 2548 - DNA, 23 bp, Artificial Sequence
  Synthetic Polynucleotide
tgggraagagtcttccacaaagg

SEQ ID NO: 2549 - DNA, 23 bp, Artificial Sequence
  Synthetic Polynucleotide
cctgtactgagggatatygactt

SEQ ID NO: 2550 - DNA, 23 bp, Artificial Sequence
  Synthetic Polynucleotide
ccggtgaccaggcccatcygcct

SEQ ID NO: 2551 - DNA, 23 bp, Artificial Sequence
  Synthetic Polynucleotide
tgartatctggctgcactgaggg

SEQ ID NO: 2552 - DNA, 23 bp, Artificial Sequence
  Synthetic Polynucleotide
gtgartatctggctgcactgagg

SEQ ID NO: 2553 - DNA, 23 bp, Artificial Sequence
  Synthetic Polynucleotide
actcrtagtatcattgagtttgg

SEQ ID NO: 2554 - DNA, 23 bp, Artificial Sequence
  Synthetic Polynucleotide
gaartttcctatcagaggtttgg

SEQ ID NO: 2555 - DNA, 23 bp, Artificial Sequence
  Synthetic Polynucleotide
ccaaagaartttcctatcagagg

SEQ ID NO: 2556 - DNA, 23 bp, Artificial Sequence
  Synthetic Polynucleotide
ccctgttgcaggtgcayagttgt

SEQ ID NO: 2557 - DNA, 23 bp, Artificial Sequence
  Synthetic Polynucleotide
cctgttgcaggtgcayagttgtg

SEQ ID NO: 2558 - DNA, 23 bp, Artificial Sequence
  Synthetic Polynucleotide
cctggaggccctggaccggyggc

SEQ ID NO: 2559 - DNA, 23 bp, Artificial Sequence
  Synthetic Polynucleotide
ccccttctccttccctaaaygag

SEQ ID NO: 2560 - DNA, 23 bp, Artificial Sequence
  Synthetic Polynucleotide
cccttctccttccctaaaygagc

SEQ ID NO: 2561 - DNA, 23 bp, Artificial Sequence
  Synthetic Polynucleotide
ccttctccttccctaaaygagcg

SEQ ID NO: 2562 - DNA, 23 bp, Artificial Sequence
  Synthetic Polynucleotide
cctgaaccccctggtcyagcgca

SEQ ID NO: 2563 - DNA, 23 bp, Artificial Sequence
  Synthetic Polynucleotide
ccgtgaccagctctaccagyagc

SEQ ID NO: 2564 - DNA, 23 bp, Artificial Sequence
  Synthetic Polynucleotide
ccacagaattctggayaatcaaa

SEQ ID NO: 2565 - DNA, 23 bp, Artificial Sequence
  Synthetic Polynucleotide
ccctgggggaattgctgygaagg

SEQ ID NO: 2566 - DNA, 23 bp, Artificial Sequence
  Synthetic Polynucleotide
cctgggggaattgctgygaaggg

SEQ ID NO: 2567 - DNA, 23 bp, Artificial Sequence
  Synthetic Polynucleotide
tcacragacttcaagatcaaagg

SEQ ID NO: 2568 - DNA, 23 bp, Artificial Sequence
  Synthetic Polynucleotide
ccaagacacagcagaayagaaag

SEQ ID NO: 2569 - DNA, 23 bp, Artificial Sequence
  Synthetic Polynucleotide
attcctraggatgcaccaactgg

SEQ ID NO: 2570 - DNA, 23 bp, Artificial Sequence
  Synthetic Polynucleotide
gaggatrgaaggtcttgccaagg

SEQ ID NO: 2571 - DNA, 23 bp, Artificial Sequence
  Synthetic Polynucleotide
ccctttaccatcttgtacyggga

SEQ ID NO: 2572 - DNA, 23 bp, Artificial Sequence
  Synthetic Polynucleotide
cctttaccatcttgtacygggac

SEQ ID NO: 2573 - DNA, 23 bp, Artificial Sequence
  Synthetic Polynucleotide
taccagtgraaccagtgtgttgg

SEQ ID NO: 2574 - DNA, 23 bp, Artificial Sequence
  Synthetic Polynucleotide
accggtrtgagtgcaacaaaggg

SEQ ID NO: 2575 - DNA, 23 bp, Artificial Sequence
  Synthetic Polynucleotide
taccggtrtgagtgcaacaaagg

SEQ ID NO: 2576 - DNA, 23 bp, Artificial Sequence
  Synthetic Polynucleotide
agaatrccgaggtatggtcctgg

SEQ ID NO: 2577 - DNA, 23 bp, Artificial Sequence
  Synthetic Polynucleotide
cctrtgggaatggaacttgccgg

SEQ ID NO: 2578 - DNA, 23 bp, Artificial Sequence
  Synthetic Polynucleotide
atgaatrtgcaagtggaaatggg

SEQ ID NO: 2579 - DNA, 23 bp, Artificial Sequence
  Synthetic Polynucleotide
gatgaatrtgcaagtggaaatgg

SEQ ID NO: 2580 - DNA, 23 bp, Artificial Sequence
  Synthetic Polynucleotide
tgtargtaagaggatccctgtgg

SEQ ID NO: 2581 - DNA, 23 bp, Artificial Sequence
  Synthetic Polynucleotide
tacaratatcgatgaatgcaagg

SEQ ID NO: 2582 - DNA, 23 bp, Artificial Sequence
  Synthetic Polynucleotide
gtacrtgatccatcctaggttgg

SEQ ID NO: 2583 - DNA, 23 bp, Artificial Sequence
  Synthetic Polynucleotide
attggtacrtgatccatcctagg

SEQ ID NO: 2584 - DNA, 23 bp, Artificial Sequence
  Synthetic Polynucleotide
cagtrcctcaatgcaccaggagg

SEQ ID NO: 2585 - DNA, 23 bp, Artificial Sequence
  Synthetic Polynucleotide
ggccagtrcctcaatgcaccagg

SEQ ID NO: 2586 - DNA, 23 bp, Artificial Sequence
  Synthetic Polynucleotide
caatgaatrtggctctgcgcagg

SEQ ID NO: 2587 - DNA, 23 bp, Artificial Sequence
  Synthetic Polynucleotide
ggttcacrcaacggccattgggg

SEQ ID NO: 2588 - DNA, 23 bp, Artificial Sequence
  Synthetic Polynucleotide
aggttcacrcaacggccattggg

SEQ ID NO: 2589 - DNA, 23 bp, Artificial Sequence
  Synthetic Polynucleotide
ggacagtrcatcaatacagatgg

SEQ ID NO: 2590 - DNA, 23 bp, Artificial Sequence
  Synthetic Polynucleotide
atgcrgtggcggccagcaatagg

SEQ ID NO: 2591 - DNA, 23 bp, Artificial Sequence
  Synthetic Polynucleotide
gccrttgcgtgaacctcataggg

SEQ ID NO: 2592 - DNA, 23 bp, Artificial Sequence
  Synthetic Polynucleotide
ggccrttgcgtgaacctcatagg

SEQ ID NO: 2593 - DNA, 23 bp, Artificial Sequence
  Synthetic Polynucleotide
ggtgtttrccataacacagaggg

SEQ ID NO: 2594 - DNA, 23 bp, Artificial Sequence
  Synthetic Polynucleotide
tggtgtttrccataacacagagg

SEQ ID NO: 2595 - DNA, 23 bp, Artificial Sequence
  Synthetic Polynucleotide
tatgaatrtagctgtcagccggg

SEQ ID NO: 2596 - DNA, 23 bp, Artificial Sequence
  Synthetic Polynucleotide
ctatgaatrtagctgtcagccgg

SEQ ID NO: 2597 - DNA, 23 bp, Artificial Sequence
  Synthetic Polynucleotide
ccagtrtgtgaacacccctgggg

SEQ ID NO: 2598 - DNA, 23 bp, Artificial Sequence
  Synthetic Polynucleotide
gccagtrtgtgaacacccctggg

SEQ ID NO: 2599 - DNA, 23 bp, Artificial Sequence
  Synthetic Polynucleotide
ggccagtrtgtgaacacccctgg

SEQ ID NO: 2600 - DNA, 23 bp, Artificial Sequence
  Synthetic Polynucleotide
gaatccccrctggcattcacagg

SEQ ID NO: 2601 - DNA, 23 bp, Artificial Sequence
  Synthetic Polynucleotide
cctggaggggaaggtttcygacc

SEQ ID NO: 2602 - DNA, 23 bp, Artificial Sequence
  Synthetic Polynucleotide
cccttccagacaatygggaaggg

SEQ ID NO: 2603 - DNA, 23 bp, Artificial Sequence
  Synthetic Polynucleotide
ccggatctgcaataatggaygct

SEQ ID NO: 2604 - DNA, 23 bp, Artificial Sequence
  Synthetic Polynucleotide
cctccctcggtgctgygtgggga

SEQ ID NO: 2605 - DNA, 23 bp, Artificial Sequence
  Synthetic Polynucleotide
cccgtgcaccctatgcyaagttg

SEQ ID NO: 2606 - DNA, 23 bp, Artificial Sequence
  Synthetic Polynucleotide
ccgtgcaccctatgcyaagttgg

SEQ ID NO: 2607 - DNA, 23 bp, Artificial Sequence
  Synthetic Polynucleotide
cctttgggagtttcyagtgccgc

SEQ ID NO: 2608 - DNA, 23 bp, Artificial Sequence
  Synthetic Polynucleotide
ccctgcctattgctggcygccac

SEQ ID NO: 2609 - DNA, 23 bp, Artificial Sequence
  Synthetic Polynucleotide
cctgcctattgctggcygccacc

SEQ ID NO: 2610 - DNA, 23 bp, Artificial Sequence
  Synthetic Polynucleotide
ccacctggttacttcygcatagg

SEQ ID NO: 2611 - DNA, 23 bp, Artificial Sequence
  Synthetic Polynucleotide
cctgaatgaagatacaygagtgt

SEQ ID NO: 2612 - DNA, 23 bp, Artificial Sequence
  Synthetic Polynucleotide
cctctgctctgtgccttcygatg

SEQ ID NO: 2613 - DNA, 23 bp, Artificial Sequence
  Synthetic Polynucleotide
cctcaaattccggtccctygacc

SEQ ID NO: 2614 - DNA, 23 bp, Artificial Sequence
  Synthetic Polynucleotide
cccaatgtctgtggatcaygtta

SEQ ID NO: 2615 - DNA, 23 bp, Artificial Sequence
  Synthetic Polynucleotide
ccaatgtctgtggatcaygttat

SEQ ID NO: 2616 - DNA, 23 bp, Artificial Sequence
  Synthetic Polynucleotide
tgtragcctggccgctgctgggg

SEQ ID NO: 2617 - DNA, 23 bp, Artificial Sequence
  Synthetic Polynucleotide
ctgtragcctggccgctgctggg

SEQ ID NO: 2618 - DNA, 23 bp, Artificial Sequence
  Synthetic Polynucleotide
gctgtragcctggccgctgctgg

SEQ ID NO: 2619 - DNA, 23 bp, Artificial Sequence
  Synthetic Polynucleotide
gcagccrgctacgcactgtatgg

SEQ ID NO: 2620 - DNA, 23 bp, Artificial Sequence
  Synthetic Polynucleotide
ccaagtgtaaaaaactcyggacc

SEQ ID NO: 2621 - DNA, 23 bp, Artificial Sequence
  Synthetic Polynucleotide
cccgagacggagccgaygctggg

SEQ ID NO: 2622 - DNA, 23 bp, Artificial Sequence
  Synthetic Polynucleotide
ccgagacggagccgaygctgggg

SEQ ID NO: 2623 - DNA, 23 bp, Artificial Sequence
  Synthetic Polynucleotide
ccgctctgtgtcaatyctgtctg

SEQ ID NO: 2624 - DNA, 23 bp, Artificial Sequence
  Synthetic Polynucleotide
ccttatggaacaaggcatcyaag

SEQ ID NO: 2625 - DNA, 23 bp, Artificial Sequence
  Synthetic Polynucleotide
atgrgagctgcgggtgtttgtgg

SEQ ID NO: 2626 - DNA, 23 bp, Artificial Sequence
  Synthetic Polynucleotide
ccaggtgrctggactcgtcgcgg

SEQ ID NO: 2627 - DNA, 23 bp, Artificial Sequence
  Synthetic Polynucleotide
ccccccgtttccagygaaagttc

SEQ ID NO: 2628 - DNA, 23 bp, Artificial Sequence
  Synthetic Polynucleotide
cctgggcatcgccaacaacygac

SEQ ID NO: 2629 - DNA, 23 bp, Artificial Sequence
  Synthetic Polynucleotide
cgtgcrtggcccaagggttgtgg

SEQ ID NO: 2630 - DNA, 23 bp, Artificial Sequence
  Synthetic Polynucleotide
ccaggtaacgaacaggyatgcaa

SEQ ID NO: 2631 - DNA, 23 bp, Artificial Sequence
  Synthetic Polynucleotide
cccagccacagcctctgccytgg

SEQ ID NO: 2632 - DNA, 23 bp, Artificial Sequence
  Synthetic Polynucleotide
ccagccacagcctctgccytggg

SEQ ID NO: 2633 - DNA, 23 bp, Artificial Sequence
  Synthetic Polynucleotide
ccacagcctctgccytgggcccc

SEQ ID NO: 2634 - DNA, 23 bp, Artificial Sequence
  Synthetic Polynucleotide
ccaacctcaatctgcctygaacc

SEQ ID NO: 2635 - DNA, 23 bp, Artificial Sequence
  Synthetic Polynucleotide
ccagagctggagaaaygaatgca

SEQ ID NO: 2636 - DNA, 23 bp, Artificial Sequence
  Synthetic Polynucleotide
ccatgaacaagaggggaygactc

SEQ ID NO: 2637 - DNA, 23 bp, Artificial Sequence
  Synthetic Polynucleotide
cctctaggaaggccygggcaggg

SEQ ID NO: 2638 - DNA, 23 bp, Artificial Sequence
  Synthetic Polynucleotide
tatcartatagcagtgggcctgg

SEQ ID NO: 2639 - DNA, 23 bp, Artificial Sequence
  Synthetic Polynucleotide
ccagartgaagatctcccacagg

SEQ ID NO: 2640 - DNA, 23 bp, Artificial Sequence
  Synthetic Polynucleotide
ccggatctacacccacyagagtg

SEQ ID NO: 2641 - DNA, 23 bp, Artificial Sequence
  Synthetic Polynucleotide
ccacctgcccaaagcagycctct

SEQ ID NO: 2642 - DNA, 23 bp, Artificial Sequence
  Synthetic Polynucleotide
cctgcccaaagcagycctctccc

SEQ ID NO: 2643 - DNA, 23 bp, Artificial Sequence
  Synthetic Polynucleotide
gcttggcrggtaattctattggg

SEQ ID NO: 2644 - DNA, 23 bp, Artificial Sequence
  Synthetic Polynucleotide
tgcttggcrggtaattctattgg

SEQ ID NO: 2645 - DNA, 23 bp, Artificial Sequence
  Synthetic Polynucleotide
tttarcagccagaaatgttttgg

SEQ ID NO: 2646 - DNA, 23 bp, Artificial Sequence
  Synthetic Polynucleotide
cacagacratgccactgacaagg

SEQ ID NO: 2647 - DNA, 23 bp, Artificial Sequence
  Synthetic Polynucleotide
cctgccctcgatacagccyggcc

SEQ ID NO: 2648 - DNA, 23 bp, Artificial Sequence
  Synthetic Polynucleotide
ccctcgatacagccyggccagca

SEQ ID NO: 2649 - DNA, 23 bp, Artificial Sequence
  Synthetic Polynucleotide
cgctrgaaggctgagcgcgaggg

SEQ ID NO: 2650 - DNA, 23 bp, Artificial Sequence
  Synthetic Polynucleotide
gcgctrgaaggctgagcgcgagg

SEQ ID NO: 2651 - DNA, 23 bp, Artificial Sequence
  Synthetic Polynucleotide
cccgagcacttcctgcagcygct

SEQ ID NO: 2652 - DNA, 23 bp, Artificial Sequence
  Synthetic Polynucleotide
ccgagcacttcctgcagcygctg

SEQ ID NO: 2653 - DNA, 23 bp, Artificial Sequence
  Synthetic Polynucleotide
cctagtacctgatggggcgyggg

SEQ ID NO: 2654 - DNA, 23 bp, Artificial Sequence
  Synthetic Polynucleotide
cctggccaggggcttcyagcgct

SEQ ID NO: 2655 - DNA, 23 bp, Artificial Sequence
  Synthetic Polynucleotide
ccctccggcacatgaggyaggta

SEQ ID NO: 2656 - DNA, 23 bp, Artificial Sequence
  Synthetic Polynucleotide
cctccggcacatgaggyaggtag

SEQ ID NO: 2657 - DNA, 23 bp, Artificial Sequence
  Synthetic Polynucleotide
cccaaagaggacacayagaagct

SEQ ID NO: 2658 - DNA, 23 bp, Artificial Sequence
  Synthetic Polynucleotide
ccaaagaggacacayagaagctg

SEQ ID NO: 2659 - DNA, 23 bp, Artificial Sequence
  Synthetic Polynucleotide
tgacrgtgaggaggggtgggggg

SEQ ID NO: 2660 - DNA, 23 bp, Artificial Sequence
  Synthetic Polynucleotide
gtgacrgtgaggaggggtggggg

SEQ ID NO: 2661 - DNA, 23 bp, Artificial Sequence
  Synthetic Polynucleotide
agtgacrgtgaggaggggtgggg

SEQ ID NO: 2662 - DNA, 23 bp, Artificial Sequence
  Synthetic Polynucleotide
aagtgacrgtgaggaggggtggg

SEQ ID NO: 2663 - DNA, 23 bp, Artificial Sequence
  Synthetic Polynucleotide
caagtgacrgtgaggaggggtgg

SEQ ID NO: 2664 - DNA, 23 bp, Artificial Sequence
  Synthetic Polynucleotide
ccattgagatctgctyggaggcg

SEQ ID NO: 2665 - DNA, 23 bp, Artificial Sequence
  Synthetic Polynucleotide
ccgcaggaggctggygagtatgc

SEQ ID NO: 2666 - DNA, 23 bp, Artificial Sequence
  Synthetic Polynucleotide
ccaagggggatgcagtgygagat

SEQ ID NO: 2667 - DNA, 23 bp, Artificial Sequence
  Synthetic Polynucleotide
ccagaacaagctgccgyagctgc

SEQ ID NO: 2668 - DNA, 23 bp, Artificial Sequence
  Synthetic Polynucleotide
ccaagtggactgctygagcgcgg

SEQ ID NO: 2669 - DNA, 23 bp, Artificial Sequence
  Synthetic Polynucleotide
ccgggactggcagagcggcyggg

SEQ ID NO: 2670 - DNA, 23 bp, Artificial Sequence
  Synthetic Polynucleotide
gtccagrgttggaagctgtaggg

SEQ ID NO: 2671 - DNA, 23 bp, Artificial Sequence
  Synthetic Polynucleotide
ggtccagrgttggaagctgtagg

SEQ ID NO: 2672 - DNA, 23 bp, Artificial Sequence
  Synthetic Polynucleotide
aagactrggcgctatatgattgg

SEQ ID NO: 2673 - DNA, 23 bp, Artificial Sequence
  Synthetic Polynucleotide
cctttgcttcaggttygagcata

SEQ ID NO: 2674 - DNA, 23 bp, Artificial Sequence
  Synthetic Polynucleotide
cctcctgctgctgggygatacac

SEQ ID NO: 2675 - DNA, 23 bp, Artificial Sequence
  Synthetic Polynucleotide
gtggccrtgaaaatgctgaaagg

SEQ ID NO: 2676 - DNA, 23 bp, Artificial Sequence
  Synthetic Polynucleotide
ctctggragatcttctctctggg

SEQ ID NO: 2677 - DNA, 23 bp, Artificial Sequence
  Synthetic Polynucleotide
tctctggragatcttctctctgg

SEQ ID NO: 2678 - DNA, 23 bp, Artificial Sequence
  Synthetic Polynucleotide
cggcrccttcgggaaggtggtgg

SEQ ID NO: 2679 - DNA, 23 bp, Artificial Sequence
  Synthetic Polynucleotide
ctacggcrccttcgggaaggtgg

SEQ ID NO: 2680 - DNA, 23 bp, Artificial Sequence
  Synthetic Polynucleotide
ccgcaggagaagtctyccgagca

SEQ ID NO: 2681 - DNA, 23 bp, Artificial Sequence
  Synthetic Polynucleotide
caccrccgtgctgggcaatcagg

SEQ ID NO: 2682 - DNA, 23 bp, Artificial Sequence
  Synthetic Polynucleotide
tttragaagagcaatgacattgg

SEQ ID NO: 2683 - DNA, 23 bp, Artificial Sequence
  Synthetic Polynucleotide
aaaaragtcctttccaggtaagg

SEQ ID NO: 2684 - DNA, 23 bp, Artificial Sequence
  Synthetic Polynucleotide
ccggacatcatgtgtatcycaac

SEQ ID NO: 2685 - DNA, 23 bp, Artificial Sequence
  Synthetic Polynucleotide
ccgccgccgcccgcgycctccgc

SEQ ID NO: 2686 - DNA, 23 bp, Artificial Sequence
  Synthetic Polynucleotide
ccctacctcggcggcgagyagag

SEQ ID NO: 2687 - DNA, 23 bp, Artificial Sequence
  Synthetic Polynucleotide
cctacctcggcggcgagyagagc

SEQ ID NO: 2688 - DNA, 23 bp, Artificial Sequence
  Synthetic Polynucleotide
ccgccacaacctctygctcaacg

SEQ ID NO: 2689 - DNA, 23 bp, Artificial Sequence
  Synthetic Polynucleotide
ccacaacagccaccaccccyagc

SEQ ID NO: 2690 - DNA, 23 bp, Artificial Sequence
  Synthetic Polynucleotide
ccccgagaagcggctcacgytca

SEQ ID NO: 2691 - DNA, 23 bp, Artificial Sequence
  Synthetic Polynucleotide
cccgagaagcggctcacgytcaa

SEQ ID NO: 2692 - DNA, 23 bp, Artificial Sequence
  Synthetic Polynucleotide
ccgagaagcggctcacgytcaac

SEQ ID NO: 2693 - DNA, 23 bp, Artificial Sequence
  Synthetic Polynucleotide
ccatccgccacaatctgtycctc

SEQ ID NO: 2694 - DNA, 23 bp, Artificial Sequence
  Synthetic Polynucleotide
ccgccacaatctgtycctcaaca

SEQ ID NO: 2695 - DNA, 23 bp, Artificial Sequence
  Synthetic Polynucleotide
ccgccgccgcagcagcagyagcc

SEQ ID NO: 2696 - DNA, 23 bp, Artificial Sequence
  Synthetic Polynucleotide
ccgccgcagcagcagyagccgcc

SEQ ID NO: 2697 - DNA, 23 bp, Artificial Sequence
  Synthetic Polynucleotide
tccgcragagcgcggagaagagg

SEQ ID NO: 2698 - DNA, 23 bp, Artificial Sequence
  Synthetic Polynucleotide
ccccccaagtacctgyagtctgg

SEQ ID NO: 2699 - DNA, 23 bp, Artificial Sequence
  Synthetic Polynucleotide
cccccaagtacctgyagtctggc

SEQ ID NO: 2700 - DNA, 23 bp, Artificial Sequence
  Synthetic Polynucleotide
ccctatgcctcctgcyagatggc

SEQ ID NO: 2701 - DNA, 23 bp, Artificial Sequence
  Synthetic Polynucleotide
cctatgcctcctgcyagatggcg

SEQ ID NO: 2702 - DNA, 23 bp, Artificial Sequence
  Synthetic Polynucleotide
ccgatrcccaaccccaggcctgg

SEQ ID NO: 2703 - DNA, 23 bp, Artificial Sequence
  Synthetic Polynucleotide
cctggtgtcattgaayaggtgcg

SEQ ID NO: 2704 - DNA, 23 bp, Artificial Sequence
  Synthetic Polynucleotide
agtrgaccctggacatctgcggg

SEQ ID NO: 2705 - DNA, 23 bp, Artificial Sequence
  Synthetic Polynucleotide
cagtrgaccctggacatctgcgg

SEQ ID NO: 2706 - DNA, 23 bp, Artificial Sequence
  Synthetic Polynucleotide
cccatctcagtaccatgaaygac

SEQ ID NO: 2707 - DNA, 23 bp, Artificial Sequence
  Synthetic Polynucleotide
ccatctcagtaccatgaaygaca

SEQ ID NO: 2708 - DNA, 23 bp, Artificial Sequence
  Synthetic Polynucleotide
ccaggatcgccaagygcatggcc

SEQ ID NO: 2709 - DNA, 23 bp, Artificial Sequence
  Synthetic Polynucleotide
ccaggatggacagtygccggacc

SEQ ID NO: 2710 - DNA, 23 bp, Artificial Sequence
  Synthetic Polynucleotide
agacrccatgaaagctgccatgg

SEQ ID NO: 2711 - DNA, 23 bp, Artificial Sequence
  Synthetic Polynucleotide
cctgcaggcctcctacayctacc

SEQ ID NO: 2712 - DNA, 23 bp, Artificial Sequence
  Synthetic Polynucleotide
acaracaggatcgcagggagagg

SEQ ID NO: 2713 - DNA, 23 bp, Artificial Sequence
  Synthetic Polynucleotide
tgagcacaracaggatcgcaggg

SEQ ID NO: 2714 - DNA, 23 bp, Artificial Sequence
  Synthetic Polynucleotide
tggctttgrccctggcaagatgg

SEQ ID NO: 2715 - DNA, 23 bp, Artificial Sequence
  Synthetic Polynucleotide
cagcrgtggctatggacagcagg

SEQ ID NO: 2716 - DNA, 23 bp, Artificial Sequence
  Synthetic Polynucleotide
gctgragtcctgtcaggtatggg

SEQ ID NO: 2717 - DNA, 23 bp, Artificial Sequence
  Synthetic Polynucleotide
tgctgragtcctgtcaggtatgg

SEQ ID NO: 2718 - DNA, 23 bp, Artificial Sequence
  Synthetic Polynucleotide
tggacagcrtccatactggtggg

SEQ ID NO: 2719 - DNA, 23 bp, Artificial Sequence
  Synthetic Polynucleotide
gatccrcgtgcagcccaacgagg

SEQ ID NO: 2720 - DNA, 23 bp, Artificial Sequence
  Synthetic Polynucleotide
gatgctgtrtctggtggccatgg

SEQ ID NO: 2721 - DNA, 23 bp, Artificial Sequence
  Synthetic Polynucleotide
cctgcagagctctgacyggctgt

SEQ ID NO: 2722 - DNA, 23 bp, Artificial Sequence
  Synthetic Polynucleotide
ccagatgcacttcgtgygcaggt

SEQ ID NO: 2723 - DNA, 23 bp, Artificial Sequence
  Synthetic Polynucleotide
ccgtgaggaccagatctacygca

SEQ ID NO: 2724 - DNA, 23 bp, Artificial Sequence
  Synthetic Polynucleotide
ccaccagcagtgcaagygcaacg

SEQ ID NO: 2725 - DNA, 23 bp, Artificial Sequence
  Synthetic Polynucleotide
cctgcgctgcggcaaggycctga

SEQ ID NO: 2726 - DNA, 23 bp, Artificial Sequence
  Synthetic Polynucleotide
ctggtcrgggccgacgtctgcgg

SEQ ID NO: 2727 - DNA, 23 bp, Artificial Sequence
  Synthetic Polynucleotide
gaargtagggcgagggtccaggg

SEQ ID NO: 2728 - DNA, 23 bp, Artificial Sequence
  Synthetic Polynucleotide
ggaargtagggcgagggtccagg

SEQ ID NO: 2729 - DNA, 23 bp, Artificial Sequence
  Synthetic Polynucleotide
ccacagagtcccgcyagcagccc

SEQ ID NO: 2730 - DNA, 23 bp, Artificial Sequence
  Synthetic Polynucleotide
cccaccctacgtgcytggtcagc

SEQ ID NO: 2731 - DNA, 23 bp, Artificial Sequence
  Synthetic Polynucleotide
ccaagggtggggaggccygaggg

SEQ ID NO: 2732 - DNA, 23 bp, Artificial Sequence
  Synthetic Polynucleotide
cctccrgttaaataacctaatgg

SEQ ID NO: 2733 - DNA, 23 bp, Artificial Sequence
  Synthetic Polynucleotide
tgcccrgaaatcgctccccaagg

SEQ ID NO: 2734 - DNA, 23 bp, Artificial Sequence
  Synthetic Polynucleotide
aaacttcrgcctgatataggagg

SEQ ID NO: 2735 - DNA, 23 bp, Artificial Sequence
  Synthetic Polynucleotide
cccaagatcagcaaccattyaaa

SEQ ID NO: 2736 - DNA, 23 bp, Artificial Sequence
  Synthetic Polynucleotide
ccaagatcagcaaccattyaaat

SEQ ID NO: 2737 - DNA, 23 bp, Artificial Sequence
  Synthetic Polynucleotide
ccattaaagtcctcygattgaac

SEQ ID NO: 2738 - DNA, 23 bp, Artificial Sequence
  Synthetic Polynucleotide
tttgcggrgctcaaggccgtggg

SEQ ID NO: 2739 - DNA, 23 bp, Artificial Sequence
  Synthetic Polynucleotide
ctttgcggrgctcaaggccgtgg

SEQ ID NO: 2740 - DNA, 23 bp, Artificial Sequence
  Synthetic Polynucleotide
tggrgtggacagcagccttaggg

SEQ ID NO: 2741 - DNA, 23 bp, Artificial Sequence
  Synthetic Polynucleotide
ctggrgtggacagcagccttagg

SEQ ID NO: 2742 - DNA, 23 bp, Artificial Sequence
  Synthetic Polynucleotide
cccttctctgcaggtgtcyggga

SEQ ID NO: 2743 - DNA, 23 bp, Artificial Sequence
  Synthetic Polynucleotide
ccttctctgcaggtgtcygggat

SEQ ID NO: 2744 - DNA, 23 bp, Artificial Sequence
  Synthetic Polynucleotide
ccaccttctacctctctyaagca

SEQ ID NO: 2745 - DNA, 23 bp, Artificial Sequence
  Synthetic Polynucleotide
ccttctacctctctyaagcagcc

SEQ ID NO: 2746 - DNA, 23 bp, Artificial Sequence
  Synthetic Polynucleotide
ttgraccggatggctgcagaagg

SEQ ID NO: 2747 - DNA, 23 bp, Artificial Sequence
  Synthetic Polynucleotide
cacrgatttgatgagtggtttgg

SEQ ID NO: 2748 - DNA, 23 bp, Artificial Sequence
  Synthetic Polynucleotide
tgaagcacrgatttgatgagtgg

SEQ ID NO: 2749 - DNA, 23 bp, Artificial Sequence
  Synthetic Polynucleotide
cctatcttctattacygtggcga

SEQ ID NO: 2750 - DNA, 23 bp, Artificial Sequence
  Synthetic Polynucleotide
catgtrcttccacccctggtcgg

SEQ ID NO: 2751 - DNA, 23 bp, Artificial Sequence
  Synthetic Polynucleotide
tatccrctacaacccgctgcagg

SEQ ID NO: 2752 - DNA, 23 bp, Artificial Sequence
  Synthetic Polynucleotide
ctcraggagtctggtaactatgg

SEQ ID NO: 2753 - DNA, 23 bp, Artificial Sequence
  Synthetic Polynucleotide
tccrggctgttgttgatgcatgg

SEQ ID NO: 2754 - DNA, 23 bp, Artificial Sequence
  Synthetic Polynucleotide
tgcatgrgcctcagtcacagagg

SEQ ID NO: 2755 - DNA, 23 bp, Artificial Sequence
  Synthetic Polynucleotide
ctgccagrtaagggtgtcagggg

SEQ ID NO: 2756 - DNA, 23 bp, Artificial Sequence
  Synthetic Polynucleotide
actgccagrtaagggtgtcaggg

SEQ ID NO: 2757 - DNA, 23 bp, Artificial Sequence
  Synthetic Polynucleotide
gcgtgagragcgatctcagcagg

SEQ ID NO: 2758 - DNA, 23 bp, Artificial Sequence
  Synthetic Polynucleotide
gctaatgragtacagccgccagg

SEQ ID NO: 2759 - DNA, 23 bp, Artificial Sequence
  Synthetic Polynucleotide
gatcaraggctggggccaactgg

SEQ ID NO: 2760 - DNA, 23 bp, Artificial Sequence
  Synthetic Polynucleotide
tcctgcrctctgccactgtccgg

SEQ ID NO: 2761 - DNA, 23 bp, Artificial Sequence
  Synthetic Polynucleotide
ccargctgcagagagactaaggg

SEQ ID NO: 2762 - DNA, 23 bp, Artificial Sequence
  Synthetic Polynucleotide
tccargctgcagagagactaagg

SEQ ID NO: 2763 - DNA, 23 bp, Artificial Sequence
  Synthetic Polynucleotide
ccattggcagctgcacgctyatt

SEQ ID NO: 2764 - DNA, 23 bp, Artificial Sequence
  Synthetic Polynucleotide
cctgccagatattgcccagygtg

SEQ ID NO: 2765 - DNA, 23 bp, Artificial Sequence
  Synthetic Polynucleotide
ccagatattgcccagygtgagga

SEQ ID NO: 2766 - DNA, 23 bp, Artificial Sequence
  Synthetic Polynucleotide
ccaagtatgacaacytctttgag

SEQ ID NO: 2767 - DNA, 23 bp, Artificial Sequence
  Synthetic Polynucleotide
ccctccgctcctgcgctytgcca

SEQ ID NO: 2768 - DNA, 23 bp, Artificial Sequence
  Synthetic Polynucleotide
cctccgctcctgcgctytgccac

SEQ ID NO: 2769 - DNA, 23 bp, Artificial Sequence
  Synthetic Polynucleotide
cctccgctcctgcgctctgycac

SEQ ID NO: 2770 - DNA, 23 bp, Artificial Sequence
  Synthetic Polynucleotide
ccgctcctgcgctctgycactgt

SEQ ID NO: 2771 - DNA, 23 bp, Artificial Sequence
  Synthetic Polynucleotide
ccatgatgggctgttytaacccc

SEQ ID NO: 2772 - DNA, 23 bp, Artificial Sequence
  Synthetic Polynucleotide
ccagacactgctgctgcccygtc

SEQ ID NO: 2773 - DNA, 23 bp, Artificial Sequence
  Synthetic Polynucleotide
ccgcatgaagcggccctggyagg

SEQ ID NO: 2774 - DNA, 23 bp, Artificial Sequence
  Synthetic Polynucleotide
cccctggtcggatgtaaygctgc

SEQ ID NO: 2775 - DNA, 23 bp, Artificial Sequence
  Synthetic Polynucleotide
ccctggtcggatgtaaygctgcc

SEQ ID NO: 2776 - DNA, 23 bp, Artificial Sequence
  Synthetic Polynucleotide
cctggtcggatgtaaygctgcca

SEQ ID NO: 2777 - DNA, 23 bp, Artificial Sequence
  Synthetic Polynucleotide
ccagacactgctgctgcycgtcg

SEQ ID NO: 2778 - DNA, 23 bp, Artificial Sequence
  Synthetic Polynucleotide
actrcaacctcacctcctggggg

SEQ ID NO: 2779 - DNA, 23 bp, Artificial Sequence
  Synthetic Polynucleotide
tactrcaacctcacctcctgggg

SEQ ID NO: 2780 - DNA, 23 bp, Artificial Sequence
  Synthetic Polynucleotide
ctactrcaacctcacctcctggg

SEQ ID NO: 2781 - DNA, 23 bp, Artificial Sequence
  Synthetic Polynucleotide
cctactrcaacctcacctcctgg

SEQ ID NO: 2782 - DNA, 23 bp, Artificial Sequence
  Synthetic Polynucleotide
caargtgcccctctgcccgcagg

SEQ ID NO: 2783 - DNA, 23 bp, Artificial Sequence
  Synthetic Polynucleotide
ccgaagtcgtgaggacgccyagg

SEQ ID NO: 2784 - DNA, 23 bp, Artificial Sequence
  Synthetic Polynucleotide
ctgtggcrgagggacaggacagg

SEQ ID NO: 2785 - DNA, 23 bp, Artificial Sequence
  Synthetic Polynucleotide
ccactccactgtggyggagggac

SEQ ID NO: 2786 - DNA, 23 bp, Artificial Sequence
  Synthetic Polynucleotide
cctacccctcctatgtgcyggcg

SEQ ID NO: 2787 - DNA, 23 bp, Artificial Sequence
  Synthetic Polynucleotide
cccctcctatgtgcyggcggctg

SEQ ID NO: 2788 - DNA, 23 bp, Artificial Sequence
  Synthetic Polynucleotide
ccactcatcaagcccaagygaag

SEQ ID NO: 2789 - DNA, 23 bp, Artificial Sequence
  Synthetic Polynucleotide
ccccactgtggcggygagatggc

SEQ ID NO: 2790 - DNA, 23 bp, Artificial Sequence
  Synthetic Polynucleotide
gcagractcttggaacagcctgg

SEQ ID NO: 2791 - DNA, 23 bp, Artificial Sequence
  Synthetic Polynucleotide
cctccgtgctgggcctgtyctac

SEQ ID NO: 2792 - DNA, 23 bp, Artificial Sequence
  Synthetic Polynucleotide
ccgtgctgggcctgtyctacctc

SEQ ID NO: 2793 - DNA, 23 bp, Artificial Sequence
  Synthetic Polynucleotide
cctcccgccagcggtgyttccag

SEQ ID NO: 2794 - DNA, 23 bp, Artificial Sequence
  Synthetic Polynucleotide
cctactccagcccctacycggct

SEQ ID NO: 2795 - DNA, 23 bp, Artificial Sequence
  Synthetic Polynucleotide
ccagaccaccaccaccaygctgt

SEQ ID NO: 2796 - DNA, 23 bp, Artificial Sequence
  Synthetic Polynucleotide
ttatggcrcagaaacgccgaggg

SEQ ID NO: 2797 - DNA, 23 bp, Artificial Sequence
  Synthetic Polynucleotide
cttatggcrcagaaacgccgagg

SEQ ID NO: 2798 - DNA, 23 bp, Artificial Sequence
  Synthetic Polynucleotide
aaccrgtgagggcaatggtgagg

SEQ ID NO: 2799 - DNA, 23 bp, Artificial Sequence
  Synthetic Polynucleotide
atgtggtcrgctggaccgactgg

SEQ ID NO: 2800 - DNA, 23 bp, Artificial Sequence
  Synthetic Polynucleotide
ccaacgcttgctgctgcyccact

SEQ ID NO: 2801 - DNA, 23 bp, Artificial Sequence
  Synthetic Polynucleotide
ccctgcagttggcccagygtccc

SEQ ID NO: 2802 - DNA, 23 bp, Artificial Sequence
  Synthetic Polynucleotide
cctgcagttggcccagygtcccg

SEQ ID NO: 2803 - DNA, 23 bp, Artificial Sequence
  Synthetic Polynucleotide
tccrctcactggcctacatgcgg

SEQ ID NO: 2804 - DNA, 23 bp, Artificial Sequence
  Synthetic Polynucleotide
ccatgccctctatcccygagcct

SEQ ID NO: 2805 - DNA, 23 bp, Artificial Sequence
  Synthetic Polynucleotide
tgattcractcattacgcatggg

SEQ ID NO: 2806 - DNA, 23 bp, Artificial Sequence
  Synthetic Polynucleotide
atgattcractcattacgcatgg

SEQ ID NO: 2807 - DNA, 23 bp, Artificial Sequence
  Synthetic Polynucleotide
gtgtgrgctcggtgtgaagatgg

SEQ ID NO: 2808 - DNA, 23 bp, Artificial Sequence
  Synthetic Polynucleotide
acacctacraaggtaggagctgg

SEQ ID NO: 2809 - DNA, 23 bp, Artificial Sequence
  Synthetic Polynucleotide
gcctgctgragtcggggtagtgg

SEQ ID NO: 2810 - DNA, 23 bp, Artificial Sequence
  Synthetic Polynucleotide
cacatrtgtatggtaatgcgagg

SEQ ID NO: 2811 - DNA, 23 bp, Artificial Sequence
  Synthetic Polynucleotide
cccgaggccaagagcgcgyagcc

SEQ ID NO: 2812 - DNA, 23 bp, Artificial Sequence
  Synthetic Polynucleotide
ccgaggccaagagcgcgyagccc

SEQ ID NO: 2813 - DNA, 23 bp, Artificial Sequence
  Synthetic Polynucleotide
agtcrgggacttcctctccctgg

SEQ ID NO: 2814 - DNA, 23 bp, Artificial Sequence
  Synthetic Polynucleotide
cttcrgggactccggcgagctgg

SEQ ID NO: 2815 - DNA, 23 bp, Artificial Sequence
  Synthetic Polynucleotide
ctcggcgrtggcctgtaagaagg

SEQ ID NO: 2816 - DNA, 23 bp, Artificial Sequence
  Synthetic Polynucleotide
gcgcrctgcgcacatgtgctcgg

SEQ ID NO: 2817 - DNA, 23 bp, Artificial Sequence
  Synthetic Polynucleotide
ggtgragaggtgtgcggaggagg

SEQ ID NO: 2818 - DNA, 23 bp, Artificial Sequence
  Synthetic Polynucleotide
gcaggtgragaggtgtgcggagg

SEQ ID NO: 2819 - DNA, 23 bp, Artificial Sequence
  Synthetic Polynucleotide
catgraggagatgcagaatgtgg

SEQ ID NO: 2820 - DNA, 23 bp, Artificial Sequence
  Synthetic Polynucleotide
ccctggtctcggcggtggyctgt

SEQ ID NO: 2821 - DNA, 23 bp, Artificial Sequence
  Synthetic Polynucleotide
cctggtctcggcggtggyctgta

SEQ ID NO: 2822 - DNA, 23 bp, Artificial Sequence
  Synthetic Polynucleotide
ccgacctccaccccaggcayggg

SEQ ID NO: 2823 - DNA, 23 bp, Artificial Sequence
  Synthetic Polynucleotide
cctccaccccaggcaygggctgc

SEQ ID NO: 2824 - DNA, 23 bp, Artificial Sequence
  Synthetic Polynucleotide
atgraaacggagacttaaagtgg

SEQ ID NO: 2825 - DNA, 23 bp, Artificial Sequence
  Synthetic Polynucleotide
ccagrctgacctgaactgcctgg

SEQ ID NO: 2826 - DNA, 23 bp, Artificial Sequence
  Synthetic Polynucleotide
gttgrtttgcttgcaggagtggg

SEQ ID NO: 2827 - DNA, 23 bp, Artificial Sequence
  Synthetic Polynucleotide
ggttgrtttgcttgcaggagtgg

SEQ ID NO: 2828 - DNA, 23 bp, Artificial Sequence
  Synthetic Polynucleotide
ccagctattcattaacttcyggg

SEQ ID NO: 2829 - DNA, 23 bp, Artificial Sequence
  Synthetic Polynucleotide
tgccrattccgctctcttctagg

SEQ ID NO: 2830 - DNA, 5 bp, Artificial Sequence
  Synthetic Polynucleotide
  misc_feature (3)..(3): n is a, c, g, or t
grnaa

SEQ ID NO: 2831 - DNA, 23 bp, Artificial Sequence
  Synthetic Polynucleotide
ccctgaaagagatcygcacgcag

SEQ ID NO: 2832 - DNA, 23 bp, Artificial Sequence
  Synthetic Polynucleotide
atgagcrctggcgcgacggctgg

SEQ ID NO: 2833 - DNA, 23 bp, Artificial Sequence
  Synthetic Polynucleotide
cctaatgaaaaaataygaaatat

SEQ ID NO: 2834 - DNA, 23 bp, Artificial Sequence
  Synthetic Polynucleotide
gctgcagrgggaagtgactgtgg

SEQ ID NO: 2835 - DNA, 23 bp, Artificial Sequence
  Synthetic Polynucleotide
tgaccrcttccagcagaggtggg

SEQ ID NO: 2836 - DNA, 23 bp, Artificial Sequence
  Synthetic Polynucleotide
atgaccrcttccagcagaggtgg

SEQ ID NO: 2837 - DNA, 23 bp, Artificial Sequence
  Synthetic Polynucleotide
tgctggtcrtgcactggggtggg

SEQ ID NO: 2838 - DNA, 23 bp, Artificial Sequence
  Synthetic Polynucleotide
cctgctctacctcctggagyagc

SEQ ID NO: 2839 - DNA, 23 bp, Artificial Sequence
  Synthetic Polynucleotide
cctaggtatgttctyctacgtca

SEQ ID NO: 2840 - DNA, 23 bp, Artificial Sequence
  Synthetic Polynucleotide
agtgtgrgccgccatcggcgagg

SEQ ID NO: 2841 - DNA, 23 bp, Artificial Sequence
  Synthetic Polynucleotide
cccagcccttcaccctgygcctg

SEQ ID NO: 2842 - DNA, 23 bp, Artificial Sequence
  Synthetic Polynucleotide
ccagcccttcaccctgygcctgg

SEQ ID NO: 2843 - DNA, 23 bp, Artificial Sequence
  Synthetic Polynucleotide
caactgctrgagggaaggtgtgg

SEQ ID NO: 2844 - DNA, 23 bp, Artificial Sequence
  Synthetic Polynucleotide
cagacctcrgcctgatgacctgg

SEQ ID NO: 2845 - DNA, 23 bp, Artificial Sequence
  Synthetic Polynucleotide
catrgtaaggtgaaaatgcgagg

SEQ ID NO: 2846 - DNA, 23 bp, Artificial Sequence
  Synthetic Polynucleotide
ccttaggcaaactcyttgacaag

SEQ ID NO: 2847 - DNA, 23 bp, Artificial Sequence
  Synthetic Polynucleotide
atggrcgactggagctttctggg

SEQ ID NO: 2848 - DNA, 23 bp, Artificial Sequence
  Synthetic Polynucleotide
aatggrcgactggagctttctgg

SEQ ID NO: 2849 - DNA, 23 bp, Artificial Sequence
  Synthetic Polynucleotide
gcatggccrgggcgctgctgcgg

SEQ ID NO: 2850 - DNA, 23 bp, Artificial Sequence
  Synthetic Polynucleotide
ccgctggccctgccycaacacgg

SEQ ID NO: 2851 - DNA, 23 bp, Artificial Sequence
  Synthetic Polynucleotide
cctggggggatgagyaggctgat

SEQ ID NO: 2852 - DNA, 23 bp, Artificial Sequence
  Synthetic Polynucleotide
ccggtggccctgccycaatgtgg

SEQ ID NO: 2853 - DNA, 23 bp, Artificial Sequence
  Synthetic Polynucleotide
ggtgttccrgctgttgtttgagg

SEQ ID NO: 2854 - DNA, 23 bp, Artificial Sequence
  Synthetic Polynucleotide
ccgggcctgtgcccgcygagccc

SEQ ID NO: 2855 - DNA, 23 bp, Artificial Sequence
  Synthetic Polynucleotide
ccttcatctgcaacayactccag

SEQ ID NO: 2856 - DNA, 23 bp, Artificial Sequence
  Synthetic Polynucleotide
ccgagtatggctctyggtcatct

SEQ ID NO: 2857 - DNA, 23 bp, Artificial Sequence
  Synthetic Polynucleotide
ccctgaaagacatactgygccgc

SEQ ID NO: 2858 - DNA, 23 bp, Artificial Sequence
  Synthetic Polynucleotide
cctgaaagacatactgygccgca

SEQ ID NO: 2859 - DNA, 23 bp, Artificial Sequence
  Synthetic Polynucleotide
ccgctccaatccaccttccygca

SEQ ID NO: 2860 - DNA, 23 bp, Artificial Sequence
  Synthetic Polynucleotide
ccaatccaccttccygcaagggc

SEQ ID NO: 2861 - DNA, 23 bp, Artificial Sequence
  Synthetic Polynucleotide
ccccatctcccatgtgyggctgt

SEQ ID NO: 2862 - DNA, 23 bp, Artificial Sequence
  Synthetic Polynucleotide
cccatctcccatgtgyggctgtg

SEQ ID NO: 2863 - DNA, 23 bp, Artificial Sequence
  Synthetic Polynucleotide
ccatctcccatgtgyggctgtgg

SEQ ID NO: 2864 - DNA, 23 bp, Artificial Sequence
  Synthetic Polynucleotide
gtctrcaacaccctgcagccagg

SEQ ID NO: 2865 - DNA, 23 bp, Artificial Sequence
  Synthetic Polynucleotide
gcagrtgagcccgccggccccgg

SEQ ID NO: 2866 - DNA, 23 bp, Artificial Sequence
  Synthetic Polynucleotide
ccccatctcccacatcyggctat

SEQ ID NO: 2867 - DNA, 23 bp, Artificial Sequence
  Synthetic Polynucleotide
cccatctcccacatcyggctatg

SEQ ID NO: 2868 - DNA, 23 bp, Artificial Sequence
  Synthetic Polynucleotide
ccatctcccacatcyggctatgg

SEQ ID NO: 2869 - DNA, 23 bp, Artificial Sequence
  Synthetic Polynucleotide
cccggaagaagatgytgcttgtg

SEQ ID NO: 2870 - DNA, 23 bp, Artificial Sequence
  Synthetic Polynucleotide
cccrtgtgccccgcttctactgg

SEQ ID NO: 2871 - DNA, 23 bp, Artificial Sequence
  Synthetic Polynucleotide
ggccrctattggccagcccgggg

SEQ ID NO: 2872 - DNA, 23 bp, Artificial Sequence
  Synthetic Polynucleotide
tggccrctattggccagcccggg

SEQ ID NO: 2873 - DNA, 23 bp, Artificial Sequence
  Synthetic Polynucleotide
ttggccrctattggccagcccgg

SEQ ID NO: 2874 - DNA, 23 bp, Artificial Sequence
  Synthetic Polynucleotide
actarggaggattacctgcttgg

SEQ ID NO: 2875 - DNA, 23 bp, Artificial Sequence
  Synthetic Polynucleotide
cccccagggagtccttgagygaa

SEQ ID NO: 2876 - DNA, 23 bp, Artificial Sequence
  Synthetic Polynucleotide
ccccagggagtccttgagygaaa

SEQ ID NO: 2877 - DNA, 23 bp, Artificial Sequence
  Synthetic Polynucleotide
cccagggagtccttgagygaaac

SEQ ID NO: 2878 - DNA, 23 bp, Artificial Sequence
  Synthetic Polynucleotide
ccagggagtccttgagygaaaca

SEQ ID NO: 2879 - DNA, 23 bp, Artificial Sequence
  Synthetic Polynucleotide
cctgcagaagcgctttygccacc

SEQ ID NO: 2880 - DNA, 23 bp, Artificial Sequence
  Synthetic Polynucleotide
ccgcttctactggaaggacyggc

SEQ ID NO: 2881 - DNA, 23 bp, Artificial Sequence
  Synthetic Polynucleotide
tctgtcrccctggagacttcggg

SEQ ID NO: 2882 - DNA, 23 bp, Artificial Sequence
  Synthetic Polynucleotide
atctgtcrccctggagacttcgg

SEQ ID NO: 2883 - DNA, 23 bp, Artificial Sequence
  Synthetic Polynucleotide
cctgtgggaaccgtcagtgyggc

SEQ ID NO: 2884 - DNA, 23 bp, Artificial Sequence
  Synthetic Polynucleotide
ccactgrgaagactgcaccaagg

SEQ ID NO: 2885 - DNA, 23 bp, Artificial Sequence
  Synthetic Polynucleotide
ccccaacagacatctyagccaag

SEQ ID NO: 2886 - DNA, 23 bp, Artificial Sequence
  Synthetic Polynucleotide
cccaacagacatctyagccaagc

SEQ ID NO: 2887 - DNA, 23 bp, Artificial Sequence
  Synthetic Polynucleotide
ccgacctgcccattyagtggaac

SEQ ID NO: 2888 - DNA, 23 bp, Artificial Sequence
  Synthetic Polynucleotide
atcccrcattggcttccccatgg

SEQ ID NO: 2889 - DNA, 23 bp, Artificial Sequence
  Synthetic Polynucleotide
cctgtagacaggctgggcycatc

SEQ ID NO: 2890 - DNA, 23 bp, Artificial Sequence
  Synthetic Polynucleotide
gaaagrctactacacatgcgtgg

SEQ ID NO: 2891 - DNA, 23 bp, Artificial Sequence
  Synthetic Polynucleotide
atgaratatttacatcgttttgg

SEQ ID NO: 2892 - DNA, 23 bp, Artificial Sequence
  Synthetic Polynucleotide
ccgttgaggtagagctcatyatt

SEQ ID NO: 2893 - DNA, 23 bp, Artificial Sequence
  Synthetic Polynucleotide
ccttccagctgggaatcygaatc

SEQ ID NO: 2894 - DNA, 23 bp, Artificial Sequence
  Synthetic Polynucleotide
ccgctgacgctgagcaccycgaa

SEQ ID NO: 2895 - DNA, 23 bp, Artificial Sequence
  Synthetic Polynucleotide
ccctgcagtgctgcagygcatcc

SEQ ID NO: 2896 - DNA, 23 bp, Artificial Sequence
  Synthetic Polynucleotide
cctgcagtgctgcagygcatcca

SEQ ID NO: 2897 - DNA, 23 bp, Artificial Sequence
  Synthetic Polynucleotide
ccgcagcaccgtgcaccgcygga

SEQ ID NO: 2898 - DNA, 23 bp, Artificial Sequence
  Synthetic Polynucleotide
ggacccrcgtaaagaccacgggg

SEQ ID NO: 2899 - DNA, 23 bp, Artificial Sequence
  Synthetic Polynucleotide
cggacccrcgtaaagaccacggg

SEQ ID NO: 2900 - DNA, 23 bp, Artificial Sequence
  Synthetic Polynucleotide
acggacccrcgtaaagaccacgg

SEQ ID NO: 2901 - DNA, 23 bp, Artificial Sequence
  Synthetic Polynucleotide
tgaccatrtgaaaaaactttggg

SEQ ID NO: 2902 - DNA, 23 bp, Artificial Sequence
  Synthetic Polynucleotide
ttgaccatrtgaaaaaactttgg

SEQ ID NO: 2903 - DNA, 23 bp, Artificial Sequence
  Synthetic Polynucleotide
gagttcragtccccaccacaggg

SEQ ID NO: 2904 - DNA, 23 bp, Artificial Sequence
  Synthetic Polynucleotide
agagttcragtccccaccacagg

SEQ ID NO: 2905 - DNA, 23 bp, Artificial Sequence
  Synthetic Polynucleotide
cgctgccdtgtcctgacttctgg

SEQ ID NO: 2906 - DNA, 23 bp, Artificial Sequence
  Synthetic Polynucleotide
ccatgagcaacctggtgcycccc

SEQ ID NO: 2907 - DNA, 23 bp, Artificial Sequence
  Synthetic Polynucleotide
gatgrgcctgattgttcctgtgg

SEQ ID NO: 2908 - DNA, 23 bp, Artificial Sequence
  Synthetic Polynucleotide
gtttcrcagcttggatgagatgg

SEQ ID NO: 2909 - DNA, 23 bp, Artificial Sequence
  Synthetic Polynucleotide
cctttttcatgcggygtaccttt

SEQ ID NO: 2910 - DNA, 23 bp, Artificial Sequence
  Synthetic Polynucleotide
tcctcrggtgagtggggccgggg

SEQ ID NO: 2911 - DNA, 23 bp, Artificial Sequence
  Synthetic Polynucleotide
atcctcrggtgagtggggccggg

SEQ ID NO: 2912 - DNA, 23 bp, Artificial Sequence
  Synthetic Polynucleotide
gatcctcrggtgagtggggccgg

SEQ ID NO: 2913 - DNA, 23 bp, Artificial Sequence
  Synthetic Polynucleotide
cccgtgcatctcttcygactctc

SEQ ID NO: 2914 - DNA, 23 bp, Artificial Sequence
  Synthetic Polynucleotide
ccgtgcatctcttcygactctcg

SEQ ID NO: 2915 - DNA, 23 bp, Artificial Sequence
  Synthetic Polynucleotide
cctgcatcctccaccttcayggc

SEQ ID NO: 2916 - DNA, 23 bp, Artificial Sequence
  Synthetic Polynucleotide
accrctccctggctatcacgagg

SEQ ID NO: 2917 - DNA, 23 bp, Artificial Sequence
  Synthetic Polynucleotide
cccatgctttgatcyacttatct

SEQ ID NO: 2918 - DNA, 23 bp, Artificial Sequence
  Synthetic Polynucleotide
ctgrctgctctttgcctctgtgg

SEQ ID NO: 2919 - DNA, 23 bp, Artificial Sequence
  Synthetic Polynucleotide
cctgatgccttacactcgcytca

SEQ ID NO: 2920 - DNA, 23 bp, Artificial Sequence
  Synthetic Polynucleotide
ttggcrgctccgacctggtgagg

SEQ ID NO: 2921 - DNA, 23 bp, Artificial Sequence
  Synthetic Polynucleotide
ctcacracgcttctaccaatggg

SEQ ID NO: 2922 - DNA, 23 bp, Artificial Sequence
  Synthetic Polynucleotide
tctcacracgcttctaccaatgg

SEQ ID NO: 2923 - DNA, 23 bp, Artificial Sequence
  Synthetic Polynucleotide
ccatcacgaatgcagagayggcg

SEQ ID NO: 2924 - DNA, 23 bp, Artificial Sequence
  Synthetic Polynucleotide
cccgccatggccgctctcayccg

SEQ ID NO: 2925 - DNA, 23 bp, Artificial Sequence
  Synthetic Polynucleotide
ccgccatggccgctctcayccgg

SEQ ID NO: 2926 - DNA, 23 bp, Artificial Sequence
  Synthetic Polynucleotide
ccatggccgctctcayccgggac

SEQ ID NO: 2927 - DNA, 23 bp, Artificial Sequence
  Synthetic Polynucleotide
ccatttcctcggtgaatacytca

SEQ ID NO: 2928 - DNA, 23 bp, Artificial Sequence
  Synthetic Polynucleotide
cccctgccctgaagaagygagtg

SEQ ID NO: 2929 - DNA, 23 bp, Artificial Sequence
  Synthetic Polynucleotide
ccctgccctgaagaagygagtgt

SEQ ID NO: 2930 - DNA, 23 bp, Artificial Sequence
  Synthetic Polynucleotide
cctgccctgaagaagygagtgtt

SEQ ID NO: 2931 - DNA, 23 bp, Artificial Sequence
  Synthetic Polynucleotide
ccatagtttgttgtcagygacac

SEQ ID NO: 2932 - DNA, 23 bp, Artificial Sequence
  Synthetic Polynucleotide
cctgcacgcccgataygctgagt

SEQ ID NO: 2933 - DNA, 23 bp, Artificial Sequence
  Synthetic Polynucleotide
atcatcrggctggggcgcatagg

SEQ ID NO: 2934 - DNA, 23 bp, Artificial Sequence
  Synthetic Polynucleotide
ctctagrccaggccattgctcgg

SEQ ID NO: 2935 - DNA, 23 bp, Artificial Sequence
  Synthetic Polynucleotide
ccacccacagaaccygcaacacc

SEQ ID NO: 2936 - DNA, 23 bp, Artificial Sequence
  Synthetic Polynucleotide
acttgtcrgaggtctggggctgg

SEQ ID NO: 2937 - DNA, 23 bp, Artificial Sequence
  Synthetic Polynucleotide
tgaggaacrttctgaagtggtgg

SEQ ID NO: 2938 - DNA, 23 bp, Artificial Sequence
  Synthetic Polynucleotide
tacctrtgcagaacccaaagggg

SEQ ID NO: 2939 - DNA, 23 bp, Artificial Sequence
  Synthetic Polynucleotide
gtacctrtgcagaacccaaaggg

SEQ ID NO: 2940 - DNA, 23 bp, Artificial Sequence
  Synthetic Polynucleotide
cgtacctrtgcagaacccaaagg

SEQ ID NO: 2941 - DNA, 23 bp, Artificial Sequence
  Synthetic Polynucleotide
cccttcctcagagcyattcagcg

SEQ ID NO: 2942 - DNA, 23 bp, Artificial Sequence
  Synthetic Polynucleotide
catrtggaccctggtgagctggg

SEQ ID NO: 2943 - DNA, 23 bp, Artificial Sequence
  Synthetic Polynucleotide
ccatrtggaccctggtgagctgg

SEQ ID NO: 2944 - DNA, 23 bp, Artificial Sequence
  Synthetic Polynucleotide
gcacacagrtaccagaggcaggg

SEQ ID NO: 2945 - DNA, 23 bp, Artificial Sequence
  Synthetic Polynucleotide
ccgtgggtgccatcyagtgccct

SEQ ID NO: 2946 - DNA, 23 bp, Artificial Sequence
  Synthetic Polynucleotide
cctgcaacgtgaaggctygatcc

SEQ ID NO: 2947 - DNA, 23 bp, Artificial Sequence
  Synthetic Polynucleotide
ccaccagcactgctgyccccagg

SEQ ID NO: 2948 - DNA, 23 bp, Artificial Sequence
  Synthetic Polynucleotide
cagcatctrgtgcggtaccgggg

SEQ ID NO: 2949 - DNA, 23 bp, Artificial Sequence
  Synthetic Polynucleotide
tgtgcaccrgtgggtcccctggg

SEQ ID NO: 2950 - DNA, 23 bp, Artificial Sequence
  Synthetic Polynucleotide
gagaatrgagatggtaagagggg

SEQ ID NO: 2951 - DNA, 23 bp, Artificial Sequence
  Synthetic Polynucleotide
tgagaatrgagatggtaagaggg

SEQ ID NO: 2952 - DNA, 23 bp, Artificial Sequence
  Synthetic Polynucleotide
atgagaatrgagatggtaagagg

SEQ ID NO: 2953 - DNA, 23 bp, Artificial Sequence
  Synthetic Polynucleotide
ccgggagcrcacggaggagctgg

SEQ ID NO: 2954 - DNA, 23 bp, Artificial Sequence
  Synthetic Polynucleotide
actcttgrtatcacgactacggg

SEQ ID NO: 2955 - DNA, 23 bp, Artificial Sequence
  Synthetic Polynucleotide
tactcttgrtatcacgactacgg

SEQ ID NO: 2956 - DNA, 23 bp, Artificial Sequence
  Synthetic Polynucleotide
gggcttcractggccgctgctgg

SEQ ID NO: 2957 - DNA, 23 bp, Artificial Sequence
  Synthetic Polynucleotide
ccatactcrctctgaataatggg

SEQ ID NO: 2958 - DNA, 23 bp, Artificial Sequence
  Synthetic Polynucleotide
ccatcaacaacacactcaycccc

SEQ ID NO: 2959 - DNA, 23 bp, Artificial Sequence
  Synthetic Polynucleotide
ccatcaacaacacaytcaccccc

SEQ ID NO: 2960 - DNA, 23 bp, Artificial Sequence
  Synthetic Polynucleotide
cctgaccaccatccgcygaatcg

SEQ ID NO: 2961 - DNA, 23 bp, Artificial Sequence
  Synthetic Polynucleotide
ccaccggtactgcatggagygag

SEQ ID NO: 2962 - DNA, 23 bp, Artificial Sequence
  Synthetic Polynucleotide
ccggtactgcatggagygagctt

SEQ ID NO: 2963 - DNA, 23 bp, Artificial Sequence
  Synthetic Polynucleotide
gatgggcrccggcattgcccagg

SEQ ID NO: 2964 - DNA, 23 bp, Artificial Sequence
  Synthetic Polynucleotide
ccggttaccccatgggccyattt

SEQ ID NO: 2965 - DNA, 23 bp, Artificial Sequence
  Synthetic Polynucleotide
aacarattacggaaagaaggagg

SEQ ID NO: 2966 - DNA, 23 bp, Artificial Sequence
  Synthetic Polynucleotide
gccaacarattacggaaagaagg

SEQ ID NO: 2967 - DNA, 23 bp, Artificial Sequence
  Synthetic Polynucleotide
cccatgttccagaggygaaggag

SEQ ID NO: 2968 - DNA, 23 bp, Artificial Sequence
  Synthetic Polynucleotide
ccatgttccagaggygaaggagg

SEQ ID NO: 2969 - DNA, 23 bp, Artificial Sequence
  Synthetic Polynucleotide
ccagatcttgattccyaggtttc

SEQ ID NO: 2970 - DNA, 23 bp, Artificial Sequence
  Synthetic Polynucleotide
ccactrcctgctggtgaccctgg

SEQ ID NO: 2971 - DNA, 23 bp, Artificial Sequence
  Synthetic Polynucleotide
cctgtrgggcaaggtgaacgtgg

SEQ ID NO: 2972 - DNA, 23 bp, Artificial Sequence
  Synthetic Polynucleotide
cctcaccctgtggagccayaccc

SEQ ID NO: 2973 - DNA, 23 bp, Artificial Sequence
  Synthetic Polynucleotide
cctcaccctgtggagcyacaccc

SEQ ID NO: 2974 - DNA, 23 bp, Artificial Sequence
  Synthetic Polynucleotide
cttraccaatagccttgacaagg

SEQ ID NO: 2975 - DNA, 23 bp, Artificial Sequence
  Synthetic Polynucleotide
cctcttgggggccccttcyccac

SEQ ID NO: 2976 - DNA, 23 bp, Artificial Sequence
  Synthetic Polynucleotide
ccagccttgccttgacyaatagc

SEQ ID NO: 2977 - DNA, 23 bp, Artificial Sequence
  Synthetic Polynucleotide
ccccaaagtcaaggcayatggca

SEQ ID NO: 2978 - DNA, 23 bp, Artificial Sequence
  Synthetic Polynucleotide
cccaaagtcaaggcayatggcaa

SEQ ID NO: 2979 - DNA, 23 bp, Artificial Sequence
  Synthetic Polynucleotide
ccaaagtcaaggcayatggcaag

SEQ ID NO: 2980 - DNA, 23 bp, Artificial Sequence
  Synthetic Polynucleotide
cccagctgagtgaactgyactgt

SEQ ID NO: 2981 - DNA, 23 bp, Artificial Sequence
  Synthetic Polynucleotide
ccagctgagtgaactgyactgtg

SEQ ID NO: 2982 - DNA, 23 bp, Artificial Sequence
  Synthetic Polynucleotide
cccaaggaagtcagcaycttctt

SEQ ID NO: 2983 - DNA, 23 bp, Artificial Sequence
  Synthetic Polynucleotide
ccaaggaagtcagcaycttcttg

SEQ ID NO: 2984 - DNA, 23 bp, Artificial Sequence
  Synthetic Polynucleotide
gaataacragcaggcttggaagg

SEQ ID NO: 2985 - DNA, 23 bp, Artificial Sequence
  Synthetic Polynucleotide
gatgartggctgcaggctggggg

SEQ ID NO: 2986 - DNA, 23 bp, Artificial Sequence
  Synthetic Polynucleotide
ggatgartggctgcaggctgggg

SEQ ID NO: 2987 - DNA, 23 bp, Artificial Sequence
  Synthetic Polynucleotide
gggatgartggctgcaggctggg

SEQ ID NO: 2988 - DNA, 23 bp, Artificial Sequence
  Synthetic Polynucleotide
cgggatgartggctgcaggctgg

SEQ ID NO: 2989 - DNA, 23 bp, Artificial Sequence
  Synthetic Polynucleotide
ccagtggttcatcccagycgtga

SEQ ID NO: 2990 - DNA, 23 bp, Artificial Sequence
  Synthetic Polynucleotide
acttgaccrgggtcatcctaggg

SEQ ID NO: 2991 - DNA, 23 bp, Artificial Sequence
  Synthetic Polynucleotide
cctgactatcgagacygtatccg

SEQ ID NO: 2992 - DNA, 23 bp, Artificial Sequence
  Synthetic Polynucleotide
tctagagraagacagaatccagg

SEQ ID NO: 2993 - DNA, 23 bp, Artificial Sequence
  Synthetic Polynucleotide
accargtaagaatgatgtctggg

SEQ ID NO: 2994 - DNA, 23 bp, Artificial Sequence
  Synthetic Polynucleotide
gaccargtaagaatgatgtctgg

SEQ ID NO: 2995 - DNA, 23 bp, Artificial Sequence
  Synthetic Polynucleotide
tcctcaccrgggcttgctgttgg

SEQ ID NO: 2996 - DNA, 23 bp, Artificial Sequence
  Synthetic Polynucleotide
accagrtaagaatgatgtctggg

SEQ ID NO: 2997 - DNA, 23 bp, Artificial Sequence
  Synthetic Polynucleotide
gaccagrtaagaatgatgtctgg

SEQ ID NO: 2998 - DNA, 23 bp, Artificial Sequence
  Synthetic Polynucleotide
gaacrtgttccactggcatctgg

SEQ ID NO: 2999 - DNA, 23 bp, Artificial Sequence
  Synthetic Polynucleotide
cctgacatttgcctatgaaygtt

SEQ ID NO: 3000 - DNA, 23 bp, Artificial Sequence
  Synthetic Polynucleotide
ccccgctttcctcacyggggctt

SEQ ID NO: 3001 - DNA, 23 bp, Artificial Sequence
  Synthetic Polynucleotide
cccgctttcctcacyggggcttg

SEQ ID NO: 3002 - DNA, 23 bp, Artificial Sequence
  Synthetic Polynucleotide
ccctccttccttcctcaygtctg

SEQ ID NO: 3003 - DNA, 23 bp, Artificial Sequence
  Synthetic Polynucleotide
cctccttccttcctcaygtctgg

SEQ ID NO: 3004 - DNA, 23 bp, Artificial Sequence
  Synthetic Polynucleotide
ccagggatacctaagcyaagaga

SEQ ID NO: 3005 - DNA, 23 bp, Artificial Sequence
  Synthetic Polynucleotide
aggcctcrggcaagtgctgttgg

SEQ ID NO: 3006 - DNA, 23 bp, Artificial Sequence
  Synthetic Polynucleotide
ccagattacgaggaattygagtc

SEQ ID NO: 3007 - DNA, 23 bp, Artificial Sequence
  Synthetic Polynucleotide
acgtrccaggtggagcacccagg

SEQ ID NO: 3008 - DNA, 23 bp, Artificial Sequence
  Synthetic Polynucleotide
ccaagtcaaagtaacaaacyata

SEQ ID NO: 3009 - DNA, 23 bp, Artificial Sequence
  Synthetic Polynucleotide
tacartacatttctggatttggg

SEQ ID NO: 3010 - DNA, 23 bp, Artificial Sequence
  Synthetic Polynucleotide
ctacartacatttctggatttgg

SEQ ID NO: 3011 - DNA, 23 bp, Artificial Sequence
  Synthetic Polynucleotide
cctcgtgatttcttgatayccat

SEQ ID NO: 3012 - DNA, 23 bp, Artificial Sequence
  Synthetic Polynucleotide
ctacrtaagcgaacccctggggg

SEQ ID NO: 3013 - DNA, 23 bp, Artificial Sequence
  Synthetic Polynucleotide
cctacrtaagcgaacccctgggg

SEQ ID NO: 3014 - DNA, 23 bp, Artificial Sequence
  Synthetic Polynucleotide
ccctacrtaagcgaacccctggg

SEQ ID NO: 3015 - DNA, 23 bp, Artificial Sequence
  Synthetic Polynucleotide
gccctacrtaagcgaacccctgg

SEQ ID NO: 3016 - DNA, 23 bp, Artificial Sequence
  Synthetic Polynucleotide
catcgtcrccactgccctctggg

SEQ ID NO: 3017 - DNA, 23 bp, Artificial Sequence
  Synthetic Polynucleotide
acatcgtcrccactgccctctgg

SEQ ID NO: 3018 - DNA, 23 bp, Artificial Sequence
  Synthetic Polynucleotide
ccattacaggggctcatttytgt

SEQ ID NO: 3019 - DNA, 23 bp, Artificial Sequence
  Synthetic Polynucleotide
gaataaggrttatcgaatggtgg

SEQ ID NO: 3020 - DNA, 23 bp, Artificial Sequence
  Synthetic Polynucleotide
cccaagaaacatatatccyagat

SEQ ID NO: 3021 - DNA, 23 bp, Artificial Sequence
  Synthetic Polynucleotide
ccaagaaacatatatccyagatt

SEQ ID NO: 3022 - DNA, 23 bp, Artificial Sequence
  Synthetic Polynucleotide
agtatcrgtaataaaggggaagg

SEQ ID NO: 3023 - DNA, 23 bp, Artificial Sequence
  Synthetic Polynucleotide
tggctgtcrtggaagcagtgagg

SEQ ID NO: 3024 - DNA, 23 bp, Artificial Sequence
  Synthetic Polynucleotide
cctgtgttccaggayggggaggg

SEQ ID NO: 3025 - DNA, 23 bp, Artificial Sequence
  Synthetic Polynucleotide
caacacccrgcttcggaagctgg

SEQ ID NO: 3026 - DNA, 23 bp, Artificial Sequence
  Synthetic Polynucleotide
tgggctrgcacaaccgggtgggg

SEQ ID NO: 3027 - DNA, 23 bp, Artificial Sequence
  Synthetic Polynucleotide
atgggctrgcacaaccgggtggg

SEQ ID NO: 3028 - DNA, 23 bp, Artificial Sequence
  Synthetic Polynucleotide
catgggctrgcacaaccgggtgg

SEQ ID NO: 3029 - DNA, 23 bp, Artificial Sequence
  Synthetic Polynucleotide
ggtacccrcaagagccaggtggg

SEQ ID NO: 3030 - DNA, 23 bp, Artificial Sequence
  Synthetic Polynucleotide
gggtacccrcaagagccaggtgg

SEQ ID NO: 3031 - DNA, 23 bp, Artificial Sequence
  Synthetic Polynucleotide
gcagcttrctcgcatacagacgg

SEQ ID NO: 3032 - DNA, 23 bp, Artificial Sequence
  Synthetic Polynucleotide
gggcgtgraagtgcgagccaagg

SEQ ID NO: 3033 - DNA, 23 bp, Artificial Sequence
  Synthetic Polynucleotide
tcgctraaagggccttcctgagg

SEQ ID NO: 3034 - DNA, 23 bp, Artificial Sequence
  Synthetic Polynucleotide
aaggrccttcctgaggcacctgg

SEQ ID NO: 3035 - DNA, 23 bp, Artificial Sequence
  Synthetic Polynucleotide
tggrccaggtacacttgaccagg

SEQ ID NO: 3036 - DNA, 23 bp, Artificial Sequence
  Synthetic Polynucleotide
ccttccctcctcccccaggyggg

SEQ ID NO: 3037 - DNA, 23 bp, Artificial Sequence
  Synthetic Polynucleotide
ccctcctcccccaggygggaaaa

SEQ ID NO: 3038 - DNA, 23 bp, Artificial Sequence
  Synthetic Polynucleotide
cctcctcccccaggygggaaaac

SEQ ID NO: 3039 - DNA, 23 bp, Artificial Sequence
  Synthetic Polynucleotide
ccttagcaactctccacagyggg

SEQ ID NO: 3040 - DNA, 23 bp, Artificial Sequence
  Synthetic Polynucleotide
ggacrtgggcatcctggccctgg

SEQ ID NO: 3041 - DNA, 23 bp, Artificial Sequence
  Synthetic Polynucleotide
agcatcrccgaaagtatgcccgg

SEQ ID NO: 3042 - DNA, 23 bp, Artificial Sequence
  Synthetic Polynucleotide
ggcrcaaagaagaagccttccgg

SEQ ID NO: 3043 - DNA, 23 bp, Artificial Sequence
  Synthetic Polynucleotide
ccacagcgtcatcgagaycttca

SEQ ID NO: 3044 - DNA, 23 bp, Artificial Sequence
  Synthetic Polynucleotide
ccctctcccagggaggaccygtg

SEQ ID NO: 3045 - DNA, 23 bp, Artificial Sequence
  Synthetic Polynucleotide
cctctcccagggaggaccygtgg

SEQ ID NO: 3046 - DNA, 23 bp, Artificial Sequence
  Synthetic Polynucleotide
agcrtgccgctctgtacacctgg

SEQ ID NO: 3047 - DNA, 23 bp, Artificial Sequence
  Synthetic Polynucleotide
ccagaatgagcgggacyggatca

SEQ ID NO: 3048 - DNA, 23 bp, Artificial Sequence
  Synthetic Polynucleotide
caacrgctggctctgagggcagg

SEQ ID NO: 3049 - DNA, 23 bp, Artificial Sequence
  Synthetic Polynucleotide
ccagcaacrgctggctctgaggg

SEQ ID NO: 3050 - DNA, 23 bp, Artificial Sequence
  Synthetic Polynucleotide
cccccctgtgaccacccycttca

SEQ ID NO: 3051 - DNA, 23 bp, Artificial Sequence
  Synthetic Polynucleotide
ccccctgtgaccacccycttcac

SEQ ID NO: 3052 - DNA, 23 bp, Artificial Sequence
  Synthetic Polynucleotide
cccctgtgaccacccycttcact

SEQ ID NO: 3053 - DNA, 23 bp, Artificial Sequence
  Synthetic Polynucleotide
ccctgtgaccacccycttcactg

SEQ ID NO: 3054 - DNA, 23 bp, Artificial Sequence
  Synthetic Polynucleotide
aatctgrttccagaacaggaggg

SEQ ID NO: 3055 - DNA, 23 bp, Artificial Sequence
  Synthetic Polynucleotide
caatctgrttccagaacaggagg

SEQ ID NO: 3056 - DNA, 23 bp, Artificial Sequence
  Synthetic Polynucleotide
cagcrcctcccagttctgagagg

SEQ ID NO: 3057 - DNA, 23 bp, Artificial Sequence
  Synthetic Polynucleotide
gaaagrtatgtatcttgaaaggg

SEQ ID NO: 3058 - DNA, 23 bp, Artificial Sequence
  Synthetic Polynucleotide
ggaaagrtatgtatcttgaaagg

SEQ ID NO: 3059 - DNA, 23 bp, Artificial Sequence
  Synthetic Polynucleotide
ttaacarcttgctggtgaaaagg

SEQ ID NO: 3060 - DNA, 23 bp, Artificial Sequence
  Synthetic Polynucleotide
ccatcacattgtagccytctgtg

SEQ ID NO: 3061 - DNA, 23 bp, Artificial Sequence
  Synthetic Polynucleotide
ccagctggatcagagaycagacc

SEQ ID NO: 3062 - DNA, 23 bp, Artificial Sequence
  Synthetic Polynucleotide
cctgcagtgtttcactgtgyggt

SEQ ID NO: 3063 - DNA, 23 bp, Artificial Sequence
  Synthetic Polynucleotide
ccaaggtcctgcttcacygaaca

SEQ ID NO: 3064 - DNA, 23 bp, Artificial Sequence
  Synthetic Polynucleotide
ggagggctrgccggccggccagg

SEQ ID NO: 3065 - DNA, 23 bp, Artificial Sequence
  Synthetic Polynucleotide
gcccagrtgtgtacagccagtgg

SEQ ID NO: 3066 - DNA, 23 bp, Artificial Sequence
  Synthetic Polynucleotide
ccgccgctrgtagtacccgcagg

SEQ ID NO: 3067 - DNA, 23 bp, Artificial Sequence
  Synthetic Polynucleotide
ggccracctggtcagcatcctgg

SEQ ID NO: 3068 - DNA, 23 bp, Artificial Sequence
  Synthetic Polynucleotide
cctcctgcccctgctgygcagct

SEQ ID NO: 3069 - DNA, 23 bp, Artificial Sequence
  Synthetic Polynucleotide
ccttcaatgtgatcygcctggtg

SEQ ID NO: 3070 - DNA, 23 bp, Artificial Sequence
  Synthetic Polynucleotide
ctggarcaggcgatggaattggg

SEQ ID NO: 3071 - DNA, 23 bp, Artificial Sequence
  Synthetic Polynucleotide
actggarcaggcgatggaattgg

SEQ ID NO: 3072 - DNA, 23 bp, Artificial Sequence
  Synthetic Polynucleotide
ccccatatgctgtctygactgca

SEQ ID NO: 3073 - DNA, 23 bp, Artificial Sequence
  Synthetic Polynucleotide
cccatatgctgtctygactgcaa

SEQ ID NO: 3074 - DNA, 23 bp, Artificial Sequence
  Synthetic Polynucleotide
aatgggtrgaatctaaaaaatgg

SEQ ID NO: 3075 - DNA, 23 bp, Artificial Sequence
  Synthetic Polynucleotide
ccaacgagatcaccatccyagtc

SEQ ID NO: 3076 - DNA, 23 bp, Artificial Sequence
  Synthetic Polynucleotide
ccaacgagatcaccatcycagtc

SEQ ID NO: 3077 - DNA, 23 bp, Artificial Sequence
  Synthetic Polynucleotide
ccggcaagcacgaggagyggcag

SEQ ID NO: 3078 - DNA, 23 bp, Artificial Sequence
  Synthetic Polynucleotide
cgctrcccgccaggctacatcgg

SEQ ID NO: 3079 - DNA, 23 bp, Artificial Sequence
  Synthetic Polynucleotide
gctgcrgccgggagagttcgtgg

SEQ ID NO: 3080 - DNA, 23 bp, Artificial Sequence
  Synthetic Polynucleotide
atcrtgagcaccacccagcgagg

SEQ ID NO: 3081 - DNA, 23 bp, Artificial Sequence
  Synthetic Polynucleotide
cctcacggagtcccatgacygac

SEQ ID NO: 3082 - DNA, 23 bp, Artificial Sequence
  Synthetic Polynucleotide
tgtggccraggcattccgtgtgg

SEQ ID NO: 3083 - DNA, 23 bp, Artificial Sequence
  Synthetic Polynucleotide
tcatgrtcttatgttcttccagg

SEQ ID NO: 3084 - DNA, 23 bp, Artificial Sequence
  Synthetic Polynucleotide
gaaacraccaacagctagtcagg

SEQ ID NO: 3085 - DNA, 23 bp, Artificial Sequence
  Synthetic Polynucleotide
cataggtcrtcatgcttatgggg

SEQ ID NO: 3086 - DNA, 23 bp, Artificial Sequence
  Synthetic Polynucleotide
ctatccrgaacatcctggggggg

SEQ ID NO: 3087 - DNA, 23 bp, Artificial Sequence
  Synthetic Polynucleotide
actatccrgaacatcctgggggg

SEQ ID NO: 3088 - DNA, 23 bp, Artificial Sequence
  Synthetic Polynucleotide
aactatccrgaacatcctggggg

SEQ ID NO: 3089 - DNA, 23 bp, Artificial Sequence
  Synthetic Polynucleotide
ccatcattgcatttacctyggat

SEQ ID NO: 3090 - DNA, 23 bp, Artificial Sequence
  Synthetic Polynucleotide
cctatagccagtatcccyggcct

SEQ ID NO: 3091 - DNA, 23 bp, Artificial Sequence
  Synthetic Polynucleotide
gctctrggccgaagtgtcgcagg

SEQ ID NO: 3092 - DNA, 23 bp, Artificial Sequence
  Synthetic Polynucleotide
gacgagrcggacccgctggtggg

SEQ ID NO: 3093 - DNA, 23 bp, Artificial Sequence
  Synthetic Polynucleotide
cgacgagrcggacccgctggtgg

SEQ ID NO: 3094 - DNA, 23 bp, Artificial Sequence
  Synthetic Polynucleotide
ccccttcgcgcagcgcaygctca

SEQ ID NO: 3095 - DNA, 23 bp, Artificial Sequence
  Synthetic Polynucleotide
cccttcgcgcagcgcaygctcac

SEQ ID NO: 3096 - DNA, 23 bp, Artificial Sequence
  Synthetic Polynucleotide
ccttcgcgcagcgcaygctcacc

SEQ ID NO: 3097 - DNA, 23 bp, Artificial Sequence
  Synthetic Polynucleotide
ccacttgatctggtyggtgttca

SEQ ID NO: 3098 - DNA, 23 bp, Artificial Sequence
  Synthetic Polynucleotide
tctcrtgatggccgtcggggagg

SEQ ID NO: 3099 - DNA, 23 bp, Artificial Sequence
  Synthetic Polynucleotide
ccttctcrtgatggccgtcgggg

SEQ ID NO: 3100 - DNA, 23 bp, Artificial Sequence
  Synthetic Polynucleotide
gccttctcrtgatggccgtcggg

SEQ ID NO: 3101 - DNA, 23 bp, Artificial Sequence
  Synthetic Polynucleotide
ccaggagaccaggctggcgyagc

SEQ ID NO: 3102 - DNA, 23 bp, Artificial Sequence
  Synthetic Polynucleotide
ccaagaagcagggattcycctca

SEQ ID NO: 3103 - DNA, 23 bp, Artificial Sequence
  Synthetic Polynucleotide
ccaaagttcctcacygtccatca

SEQ ID NO: 3104 - DNA, 23 bp, Artificial Sequence
  Synthetic Polynucleotide
gccatcccrcttccaggccaagg

SEQ ID NO: 3105 - DNA, 23 bp, Artificial Sequence
  Synthetic Polynucleotide
ccagccacttgctgyagttgttg

SEQ ID NO: 3106 - DNA, 23 bp, Artificial Sequence
  Synthetic Polynucleotide
ttcrtcagatccaacaggaaagg

SEQ ID NO: 3107 - DNA, 23 bp, Artificial Sequence
  Synthetic Polynucleotide
tgtccttcrtcagatccaacagg

SEQ ID NO: 3108 - DNA, 23 bp, Artificial Sequence
  Synthetic Polynucleotide
ccaggccccaacctcaggyagcg

SEQ ID NO: 3109 - DNA, 23 bp, Artificial Sequence
  Synthetic Polynucleotide
accragggctgggacgaggacgg

SEQ ID NO: 3110 - DNA, 23 bp, Artificial Sequence
  Synthetic Polynucleotide
ggtgaccragggctgggacgagg

SEQ ID NO: 3111 - DNA, 23 bp, Artificial Sequence
  Synthetic Polynucleotide
cgccraccgcctcatgacccagg

SEQ ID NO: 3112 - DNA, 23 bp, Artificial Sequence
  Synthetic Polynucleotide
gctgcrggtgaccgagggctggg

SEQ ID NO: 3113 - DNA, 23 bp, Artificial Sequence
  Synthetic Polynucleotide
agctgcrggtgaccgagggctgg

SEQ ID NO: 3114 - DNA, 23 bp, Artificial Sequence
  Synthetic Polynucleotide
ccgcgcggtggacatcaycacat

SEQ ID NO: 3115 - DNA, 23 bp, Artificial Sequence
  Synthetic Polynucleotide
ccgccacgcaaactcgtgcygct

SEQ ID NO: 3116 - DNA, 23 bp, Artificial Sequence
  Synthetic Polynucleotide
ccacgcaaactcgtgcygctcgc

SEQ ID NO: 3117 - DNA, 23 bp, Artificial Sequence
  Synthetic Polynucleotide
ccacagtgtcctggctgagygac

SEQ ID NO: 3118 - DNA, 23 bp, Artificial Sequence
  Synthetic Polynucleotide
cccaagtgccagtatyaggcccc

SEQ ID NO: 3119 - DNA, 23 bp, Artificial Sequence
  Synthetic Polynucleotide
ccaagtgccagtatyaggcccct

SEQ ID NO: 3120 - DNA, 23 bp, Artificial Sequence
  Synthetic Polynucleotide
cctccagctgtatgtgcggygcc

SEQ ID NO: 3121 - DNA, 23 bp, Artificial Sequence
  Synthetic Polynucleotide
ccagctgtatgtgcggygccgaa

SEQ ID NO: 3122 - DNA, 23 bp, Artificial Sequence
  Synthetic Polynucleotide
ccctgtcctatgaccttaycgca

SEQ ID NO: 3123 - DNA, 23 bp, Artificial Sequence
  Synthetic Polynucleotide
cctgtcctatgaccttaycgcag

SEQ ID NO: 3124 - DNA, 23 bp, Artificial Sequence
  Synthetic Polynucleotide
cctaggagctgatagcyagaggt

SEQ ID NO: 3125 - DNA, 23 bp, Artificial Sequence
  Synthetic Polynucleotide
ccagtgagtgctgttttyaggac

SEQ ID NO: 3126 - DNA, 23 bp, Artificial Sequence
  Synthetic Polynucleotide
cttccraggggtaccggttgggg

SEQ ID NO: 3127 - DNA, 23 bp, Artificial Sequence
  Synthetic Polynucleotide
acttccraggggtaccggttggg

SEQ ID NO: 3128 - DNA, 23 bp, Artificial Sequence
  Synthetic Polynucleotide
aacttccraggggtaccggttgg

SEQ ID NO: 3129 - DNA, 23 bp, Artificial Sequence
  Synthetic Polynucleotide
ccctctctgcccgcagatcyagc

SEQ ID NO: 3130 - DNA, 23 bp, Artificial Sequence
  Synthetic Polynucleotide
cctctctgcccgcagatcyagcc

SEQ ID NO: 3131 - DNA, 23 bp, Artificial Sequence
  Synthetic Polynucleotide
gggctrgagcatctttgagctgg

SEQ ID NO: 3132 - DNA, 23 bp, Artificial Sequence
  Synthetic Polynucleotide
ccctgtcaggacgatgcccygaa

SEQ ID NO: 3133 - DNA, 23 bp, Artificial Sequence
  Synthetic Polynucleotide
cctgtcaggacgatgcccygaat

SEQ ID NO: 3134 - DNA, 23 bp, Artificial Sequence
  Synthetic Polynucleotide
ccagttaaacctgaggctycttt

SEQ ID NO: 3135 - DNA, 23 bp, Artificial Sequence
  Synthetic Polynucleotide
gggcrtcgacgtcatagtcttgg

SEQ ID NO: 3136 - DNA, 23 bp, Artificial Sequence
  Synthetic Polynucleotide
ccaggccaacgaggtgyggaagg

SEQ ID NO: 3137 - DNA, 23 bp, Artificial Sequence
  Synthetic Polynucleotide
cagctgcrgaacgagtttatcgg

SEQ ID NO: 3138 - DNA, 23 bp, Artificial Sequence
  Synthetic Polynucleotide
agcrgctgctggactacaccagg

SEQ ID NO: 3139 - DNA, 23 bp, Artificial Sequence
  Synthetic Polynucleotide
ccagacctctcaccatcacygcc

SEQ ID NO: 3140 - DNA, 23 bp, Artificial Sequence
  Synthetic Polynucleotide
cctctcaccatcacygccaccac

SEQ ID NO: 3141 - DNA, 23 bp, Artificial Sequence
  Synthetic Polynucleotide
cctgrcagcgagaaactgcatgg

SEQ ID NO: 3142 - DNA, 23 bp, Artificial Sequence
  Synthetic Polynucleotide
tatcgactrgtcccgtatcctgg

SEQ ID NO: 3143 - DNA, 23 bp, Artificial Sequence
  Synthetic Polynucleotide
tactaccrgaaagggggcaaggg

SEQ ID NO: 3144 - DNA, 23 bp, Artificial Sequence
  Synthetic Polynucleotide
ttactaccrgaaagggggcaagg

SEQ ID NO: 3145 - DNA, 23 bp, Artificial Sequence
  Synthetic Polynucleotide
ccctgtacrgtggatggcaccgg

SEQ ID NO: 3146 - DNA, 23 bp, Artificial Sequence
  Synthetic Polynucleotide
gtacrtgccggacgagtgggagg

SEQ ID NO: 3147 - DNA, 23 bp, Artificial Sequence
  Synthetic Polynucleotide
tgtgtacrtgccggacgagtggg

SEQ ID NO: 3148 - DNA, 23 bp, Artificial Sequence
  Synthetic Polynucleotide
ctgtgtacrtgccggacgagtgg

SEQ ID NO: 3149 - DNA, 23 bp, Artificial Sequence
  Synthetic Polynucleotide
ccaagaaacaaagtgacayaagc

SEQ ID NO: 3150 - DNA, 23 bp, Artificial Sequence
  Synthetic Polynucleotide
ccgagttgaactgaagaaaygag

SEQ ID NO: 3151 - DNA, 23 bp, Artificial Sequence
  Synthetic Polynucleotide
ccatgagactttccygagaattg

SEQ ID NO: 3152 - DNA, 23 bp, Artificial Sequence
  Synthetic Polynucleotide
gatgagtcrctccactttctggg

SEQ ID NO: 3153 - DNA, 23 bp, Artificial Sequence
  Synthetic Polynucleotide
cctcctgccctgcagccagyggt

SEQ ID NO: 3154 - DNA, 23 bp, Artificial Sequence
  Synthetic Polynucleotide
cctgccctgcagccagyggtact

SEQ ID NO: 3155 - DNA, 23 bp, Artificial Sequence
  Synthetic Polynucleotide
ccatccagacagccttcygccag

SEQ ID NO: 3156 - DNA, 23 bp, Artificial Sequence
  Synthetic Polynucleotide
ccatcaacatatgtgygctgcct

SEQ ID NO: 3157 - DNA, 23 bp, Artificial Sequence
  Synthetic Polynucleotide
atgrccagatgggaaaccattgg

SEQ ID NO: 3158 - DNA, 23 bp, Artificial Sequence
  Synthetic Polynucleotide
ccacccggcatagccctyaacaa

SEQ ID NO: 3159 - DNA, 23 bp, Artificial Sequence
  Synthetic Polynucleotide
cccggcatagccctyaacaagaa

SEQ ID NO: 3160 - DNA, 23 bp, Artificial Sequence
  Synthetic Polynucleotide
cccccccagatcatggycctcca

SEQ ID NO: 3161 - DNA, 23 bp, Artificial Sequence
  Synthetic Polynucleotide
ccccccagatcatggycctccac

SEQ ID NO: 3162 - DNA, 23 bp, Artificial Sequence
  Synthetic Polynucleotide
cccccagatcatggycctccacc

SEQ ID NO: 3163 - DNA, 23 bp, Artificial Sequence
  Synthetic Polynucleotide
cctgaacaggtcattycagtagt

SEQ ID NO: 3164 - DNA, 23 bp, Artificial Sequence
  Synthetic Polynucleotide
ccgcctgcagatctyaaccccag

SEQ ID NO: 3165 - DNA, 23 bp, Artificial Sequence
  Synthetic Polynucleotide
cccgagcggtgtggcgctgyagg

SEQ ID NO: 3166 - DNA, 23 bp, Artificial Sequence
  Synthetic Polynucleotide
ccgagcggtgtggcgctgyagga

SEQ ID NO: 3167 - DNA, 23 bp, Artificial Sequence
  Synthetic Polynucleotide
ctcrtttgtaggtcacctaaagg

SEQ ID NO: 3168 - DNA, 23 bp, Artificial Sequence
  Synthetic Polynucleotide
ggccgtggrcgagttcgacgggg

SEQ ID NO: 3169 - DNA, 23 bp, Artificial Sequence
  Synthetic Polynucleotide
ccaccatggccttccttygagta

SEQ ID NO: 3170 - DNA, 23 bp, Artificial Sequence
  Synthetic Polynucleotide
ccatggccttccttygagtacgc

SEQ ID NO: 3171 - DNA, 23 bp, Artificial Sequence
  Synthetic Polynucleotide
ccggccccgcctggcttaygtgg

SEQ ID NO: 3172 - DNA, 23 bp, Artificial Sequence
  Synthetic Polynucleotide
ccccgcctggcttaygtggccaa

SEQ ID NO: 3173 - DNA, 23 bp, Artificial Sequence
  Synthetic Polynucleotide
cctgcaaaaggcactcygatggc

SEQ ID NO: 3174 - DNA, 23 bp, Artificial Sequence
  Synthetic Polynucleotide
gccrgtggggacagaacaaaagg

SEQ ID NO: 3175 - DNA, 23 bp, Artificial Sequence
  Synthetic Polynucleotide
cgacrgccgctgtcacctggagg

SEQ ID NO: 3176 - DNA, 23 bp, Artificial Sequence
  Synthetic Polynucleotide
caacgacrgccgctgtcacctgg

SEQ ID NO: 3177 - DNA, 23 bp, Artificial Sequence
  Synthetic Polynucleotide
tgccacctrcctcaacaatgagg

SEQ ID NO: 3178 - DNA, 23 bp, Artificial Sequence
  Synthetic Polynucleotide
ccgggrcatggtggagttccagg

SEQ ID NO: 3179 - DNA, 23 bp, Artificial Sequence
  Synthetic Polynucleotide
ccggcgctrcaacacccaggcgg

SEQ ID NO: 3180 - DNA, 23 bp, Artificial Sequence
  Synthetic Polynucleotide
ccctctctgcagacygaggacgc

SEQ ID NO: 3181 - DNA, 23 bp, Artificial Sequence
  Synthetic Polynucleotide
cctggtgactcgactcyggtatc

SEQ ID NO: 3182 - DNA, 23 bp, Artificial Sequence
  Synthetic Polynucleotide
gattcctgrtaagtagcaccggg

SEQ ID NO: 3183 - DNA, 23 bp, Artificial Sequence
  Synthetic Polynucleotide
cctgcacgtgagggaagyctttg

SEQ ID NO: 3184 - DNA, 23 bp, Artificial Sequence
  Synthetic Polynucleotide
acgrcatctgtaatgagccctgg

SEQ ID NO: 3185 - DNA, 23 bp, Artificial Sequence
  Synthetic Polynucleotide
ccactttgagtatcagatcygcg

SEQ ID NO: 3186 - DNA, 23 bp, Artificial Sequence
  Synthetic Polynucleotide
ggcacaatrgcgtctcgagcagg

SEQ ID NO: 3187 - DNA, 23 bp, Artificial Sequence
  Synthetic Polynucleotide
ccttctggttggcctcagcygac

SEQ ID NO: 3188 - DNA, 23 bp, Artificial Sequence
  Synthetic Polynucleotide
ccartaagtgtcagggagccggg

SEQ ID NO: 3189 - DNA, 23 bp, Artificial Sequence
  Synthetic Polynucleotide
gccartaagtgtcagggagccgg

SEQ ID NO: 3190 - DNA, 23 bp, Artificial Sequence
  Synthetic Polynucleotide
tcacratctcatggaaatcacgg

SEQ ID NO: 3191 - DNA, 23 bp, Artificial Sequence
  Synthetic Polynucleotide
ccatcaacgacctgtyggtggtg

SEQ ID NO: 3192 - DNA, 23 bp, Artificial Sequence
  Synthetic Polynucleotide
tccrgttggtaagagtctttagg

SEQ ID NO: 3193 - DNA, 23 bp, Artificial Sequence
  Synthetic Polynucleotide
ccggraaacagatttgtgaaagg

SEQ ID NO: 3194 - DNA, 23 bp, Artificial Sequence
  Synthetic Polynucleotide
gtccratgcctggcaagagaagg

SEQ ID NO: 3195 - DNA, 23 bp, Artificial Sequence
  Synthetic Polynucleotide
tctacatcragtccgatgcctgg

SEQ ID NO: 3196 - DNA, 23 bp, Artificial Sequence
  Synthetic Polynucleotide
ttcttcrgcttcttcaccctggg

SEQ ID NO: 3197 - DNA, 23 bp, Artificial Sequence
  Synthetic Polynucleotide
attcttcrgcttcttcaccctgg

SEQ ID NO: 3198 - DNA, 23 bp, Artificial Sequence
  Synthetic Polynucleotide
ccagcttcttggagyggatgtag

SEQ ID NO: 3199 - DNA, 23 bp, Artificial Sequence
  Synthetic Polynucleotide
ccaagaagctggagcactygaac

SEQ ID NO: 3200 - DNA, 23 bp, Artificial Sequence
  Synthetic Polynucleotide
cctgtctaacaccayagcggtga

SEQ ID NO: 3201 - DNA, 23 bp, Artificial Sequence
  Synthetic Polynucleotide
ccatgagaacattggtgyggctg

SEQ ID NO: 3202 - DNA, 23 bp, Artificial Sequence
  Synthetic Polynucleotide
ccaatttcacacagaygctggaa

SEQ ID NO: 3203 - DNA, 23 bp, Artificial Sequence
  Synthetic Polynucleotide
tgaatatrgagctgctgtgctgg

SEQ ID NO: 3204 - DNA, 23 bp, Artificial Sequence
  Synthetic Polynucleotide
ccggccgrgggggccgtgggggg

SEQ ID NO: 3205 - DNA, 23 bp, Artificial Sequence
  Synthetic Polynucleotide
gccggccgrgggggccgtggggg

SEQ ID NO: 3206 - DNA, 23 bp, Artificial Sequence
  Synthetic Polynucleotide
agcttctrgggggacagtcgggg

SEQ ID NO: 3207 - DNA, 23 bp, Artificial Sequence
  Synthetic Polynucleotide
cagcttctrgggggacagtcggg

SEQ ID NO: 3208 - DNA, 23 bp, Artificial Sequence
  Synthetic Polynucleotide
cgggtgcargtcctgtccctggg

SEQ ID NO: 3209 - DNA, 23 bp, Artificial Sequence
  Synthetic Polynucleotide
gctrtgagtgtgcccaggggcgg

SEQ ID NO: 3210 - DNA, 23 bp, Artificial Sequence
  Synthetic Polynucleotide
ttggctrtgagtgtgcccagggg

SEQ ID NO: 3211 - DNA, 23 bp, Artificial Sequence
  Synthetic Polynucleotide
attggctrtgagtgtgcccaggg

SEQ ID NO: 3212 - DNA, 23 bp, Artificial Sequence
  Synthetic Polynucleotide
cattggctrtgagtgtgcccagg

SEQ ID NO: 3213 - DNA, 23 bp, Artificial Sequence
  Synthetic Polynucleotide
ggcrgagggggctggagctgcgg

SEQ ID NO: 3214 - DNA, 23 bp, Artificial Sequence
  Synthetic Polynucleotide
catcraggccatgcgcgccgggg

SEQ ID NO: 3215 - DNA, 23 bp, Artificial Sequence
  Synthetic Polynucleotide
acatcraggccatgcgcgccggg

SEQ ID NO: 3216 - DNA, 23 bp, Artificial Sequence
  Synthetic Polynucleotide
gacatcraggccatgcgcgccgg

SEQ ID NO: 3217 - DNA, 23 bp, Artificial Sequence
  Synthetic Polynucleotide
cctgggcgdcccctccatcaagg

SEQ ID NO: 3218 - DNA, 23 bp, Artificial Sequence
  Synthetic Polynucleotide
cagtcrgggccgccagtaccagg

SEQ ID NO: 3219 - DNA, 23 bp, Artificial Sequence
  Synthetic Polynucleotide
cccgggrcgacgtggagagcagg

SEQ ID NO: 3220 - DNA, 23 bp, Artificial Sequence
  Synthetic Polynucleotide
agcrcaagttgtccttccgcagg

SEQ ID NO: 3221 - DNA, 23 bp, Artificial Sequence
  Synthetic Polynucleotide
ctccarccctgagagcagtgagg

SEQ ID NO: 3222 - DNA, 23 bp, Artificial Sequence
  Synthetic Polynucleotide
ccargggaggtgtcggccttggg

SEQ ID NO: 3223 - DNA, 23 bp, Artificial Sequence
  Synthetic Polynucleotide
gccargggaggtgtcggccttgg

SEQ ID NO: 3224 - DNA, 23 bp, Artificial Sequence
  Synthetic Polynucleotide
gtagccrgggccggccggggggg

SEQ ID NO: 3225 - DNA, 23 bp, Artificial Sequence
  Synthetic Polynucleotide
agtagccrgggccggccgggggg

SEQ ID NO: 3226 - DNA, 23 bp, Artificial Sequence
  Synthetic Polynucleotide
gagtagccrgggccggccggggg

SEQ ID NO: 3227 - DNA, 23 bp, Artificial Sequence
  Synthetic Polynucleotide
agcttctgrggggacagtcgggg

SEQ ID NO: 3228 - DNA, 23 bp, Artificial Sequence
  Synthetic Polynucleotide
gtcgccccrcaggatctcgatgg

SEQ ID NO: 3229 - DNA, 23 bp, Artificial Sequence
  Synthetic Polynucleotide
ccggccgctgggcgcctacytgg

SEQ ID NO: 3230 - DNA, 23 bp, Artificial Sequence
  Synthetic Polynucleotide
ccgctgggcgcctacytgggtga

SEQ ID NO: 3231 - DNA, 23 bp, Artificial Sequence
  Synthetic Polynucleotide
cccgctaccacacayagatgctg

SEQ ID NO: 3232 - DNA, 23 bp, Artificial Sequence
  Synthetic Polynucleotide
ccagtaccaggagctccctygat

SEQ ID NO: 3233 - DNA, 23 bp, Artificial Sequence
  Synthetic Polynucleotide
cctaagataaaggagygaaccca

SEQ ID NO: 3234 - DNA, 23 bp, Artificial Sequence
  Synthetic Polynucleotide
cctttgcgctcatcgcgyactgg

SEQ ID NO: 3235 - DNA, 23 bp, Artificial Sequence
  Synthetic Polynucleotide
ccatgcacccactgygcagcggc

SEQ ID NO: 3236 - DNA, 23 bp, Artificial Sequence
  Synthetic Polynucleotide
ccttcctgctgaaggagayggaa

SEQ ID NO: 3237 - DNA, 23 bp, Artificial Sequence
  Synthetic Polynucleotide
cctgctgaaggagayggaagaag

SEQ ID NO: 3238 - DNA, 23 bp, Artificial Sequence
  Synthetic Polynucleotide
ccccggccgcatcgccgtcyact

SEQ ID NO: 3239 - DNA, 23 bp, Artificial Sequence
  Synthetic Polynucleotide
cccggccgcatcgccgtcyacta

SEQ ID NO: 3240 - DNA, 23 bp, Artificial Sequence
  Synthetic Polynucleotide
ccggccgcatcgccgtcyactac

SEQ ID NO: 3241 - DNA, 23 bp, Artificial Sequence
  Synthetic Polynucleotide
ccccaatcccctgcgccagygcc

SEQ ID NO: 3242 - DNA, 23 bp, Artificial Sequence
  Synthetic Polynucleotide
cccaatcccctgcgccagygcct

SEQ ID NO: 3243 - DNA, 23 bp, Artificial Sequence
  Synthetic Polynucleotide
ccaatcccctgcgccagygcctc

SEQ ID NO: 3244 - DNA, 23 bp, Artificial Sequence
  Synthetic Polynucleotide
cctctccagcccgggtcggyggc

SEQ ID NO: 3245 - DNA, 23 bp, Artificial Sequence
  Synthetic Polynucleotide
ccagcccgggtcggyggccccgg

SEQ ID NO: 3246 - DNA, 23 bp, Artificial Sequence
  Synthetic Polynucleotide
cccagcccctgcacagayacggc

SEQ ID NO: 3247 - DNA, 23 bp, Artificial Sequence
  Synthetic Polynucleotide
ccagcccctgcacagayacggct

SEQ ID NO: 3248 - DNA, 23 bp, Artificial Sequence
  Synthetic Polynucleotide
cctttgcgctcatcgygcactgg

SEQ ID NO: 3249 - DNA, 23 bp, Artificial Sequence
  Synthetic Polynucleotide
ccacacatggactcaygcatcgg

SEQ ID NO: 3250 - DNA, 23 bp, Artificial Sequence
  Synthetic Polynucleotide
cctcgaggagtacttcyagcacg

SEQ ID NO: 3251 - DNA, 23 bp, Artificial Sequence
  Synthetic Polynucleotide
ccccatcctcgttcttcaygggc

SEQ ID NO: 3252 - DNA, 23 bp, Artificial Sequence
  Synthetic Polynucleotide
cccatcctcgttcttcaygggca

SEQ ID NO: 3253 - DNA, 23 bp, Artificial Sequence
  Synthetic Polynucleotide
ccatcctcgttcttcaygggcac

SEQ ID NO: 3254 - DNA, 23 bp, Artificial Sequence
  Synthetic Polynucleotide
ccttggggccgggccgggygggg

SEQ ID NO: 3255 - DNA, 23 bp, Artificial Sequence
  Synthetic Polynucleotide
aacrcagtgatcagcaaacgggg

SEQ ID NO: 3256 - DNA, 23 bp, Artificial Sequence
  Synthetic Polynucleotide
gaacrcagtgatcagcaaacggg

SEQ ID NO: 3257 - DNA, 23 bp, Artificial Sequence
  Synthetic Polynucleotide
agaacrcagtgatcagcaaacgg

SEQ ID NO: 3258 - DNA, 23 bp, Artificial Sequence
  Synthetic Polynucleotide
ccctgcctcatgatcygagttgc

SEQ ID NO: 3259 - DNA, 23 bp, Artificial Sequence
  Synthetic Polynucleotide
cctgcctcatgatcygagttgcc

SEQ ID NO: 3260 - DNA, 23 bp, Artificial Sequence
  Synthetic Polynucleotide
ccacctgtcaggtgygcacttcc

SEQ ID NO: 3261 - DNA, 23 bp, Artificial Sequence
  Synthetic Polynucleotide
cctccgtgacagcactgtaygct

SEQ ID NO: 3262 - DNA, 23 bp, Artificial Sequence
  Synthetic Polynucleotide
ccgtgacagcactgtaygctacg

SEQ ID NO: 3263 - DNA, 23 bp, Artificial Sequence
  Synthetic Polynucleotide
ggagcaggrccgcttcctgcagg

SEQ ID NO: 3264 - DNA, 23 bp, Artificial Sequence
  Synthetic Polynucleotide
ggacrtgttcaccacgctggtgg

SEQ ID NO: 3265 - DNA, 23 bp, Artificial Sequence
  Synthetic Polynucleotide
gcaggacrtgttcaccacgctgg

SEQ ID NO: 3266 - DNA, 23 bp, Artificial Sequence
  Synthetic Polynucleotide
cctcragatcatcgtcatcctgg

SEQ ID NO: 3267 - DNA, 23 bp, Artificial Sequence
  Synthetic Polynucleotide
ccgcctctgcttcatgctaygtg

SEQ ID NO: 3268 - DNA, 23 bp, Artificial Sequence
  Synthetic Polynucleotide
cctctgcttcatgctaygtgtgg

SEQ ID NO: 3269 - DNA, 23 bp, Artificial Sequence
  Synthetic Polynucleotide
cctcttctccatcgagaygcaga

SEQ ID NO: 3270 - DNA, 23 bp, Artificial Sequence
  Synthetic Polynucleotide
ccgggatggcctcagccccyagg

SEQ ID NO: 3271 - DNA, 23 bp, Artificial Sequence
  Synthetic Polynucleotide
cctatgaggtgccctctaygccc

SEQ ID NO: 3272 - DNA, 23 bp, Artificial Sequence
  Synthetic Polynucleotide
atcatcratgctttcatcattgg

SEQ ID NO: 3273 - DNA, 23 bp, Artificial Sequence
  Synthetic Polynucleotide
ccaagatggcaaagcyaaagaag

SEQ ID NO: 3274 - DNA, 23 bp, Artificial Sequence
  Synthetic Polynucleotide
caccattrgttatggctaccggg

SEQ ID NO: 3275 - DNA, 23 bp, Artificial Sequence
  Synthetic Polynucleotide
ccaccattrgttatggctaccgg

SEQ ID NO: 3276 - DNA, 23 bp, Artificial Sequence
  Synthetic Polynucleotide
catcrgggccttcctcaacctgg

SEQ ID NO: 3277 - DNA, 23 bp, Artificial Sequence
  Synthetic Polynucleotide
aggagrtgggcacggccaaacgg

SEQ ID NO: 3278 - DNA, 23 bp, Artificial Sequence
  Synthetic Polynucleotide
gacaargtaggctcacgcgccgg

SEQ ID NO: 3279 - DNA, 23 bp, Artificial Sequence
  Synthetic Polynucleotide
tcctcragcgtcccaccggctgg

SEQ ID NO: 3280 - DNA, 23 bp, Artificial Sequence
  Synthetic Polynucleotide
ctgraagatctacatccggaagg

SEQ ID NO: 3281 - DNA, 23 bp, Artificial Sequence
  Synthetic Polynucleotide
ccacctgraagatctacatccgg

SEQ ID NO: 3282 - DNA, 23 bp, Artificial Sequence
  Synthetic Polynucleotide
ctgcrtgggctccaaggggcagg

SEQ ID NO: 3283 - DNA, 23 bp, Artificial Sequence
  Synthetic Polynucleotide
tcctctgcrtgggctccaagggg

SEQ ID NO: 3284 - DNA, 23 bp, Artificial Sequence
  Synthetic Polynucleotide
cccaggrgattcttggctcgggg

SEQ ID NO: 3285 - DNA, 23 bp, Artificial Sequence
  Synthetic Polynucleotide
tcccaggrgattcttggctcggg

SEQ ID NO: 3286 - DNA, 23 bp, Artificial Sequence
  Synthetic Polynucleotide
ttcccaggrgattcttggctcgg

SEQ ID NO: 3287 - DNA, 23 bp, Artificial Sequence
  Synthetic Polynucleotide
tacrcagatgcgctgtggtgggg

SEQ ID NO: 3288 - DNA, 23 bp, Artificial Sequence
  Synthetic Polynucleotide
ctacrcagatgcgctgtggtggg

SEQ ID NO: 3289 - DNA, 23 bp, Artificial Sequence
  Synthetic Polynucleotide
gctacrcagatgcgctgtggtgg

SEQ ID NO: 3290 - DNA, 23 bp, Artificial Sequence
  Synthetic Polynucleotide
gcagctacrcagatgcgctgtgg

SEQ ID NO: 3291 - DNA, 23 bp, Artificial Sequence
  Synthetic Polynucleotide
tgtgrccaagaagaaattccagg

SEQ ID NO: 3292 - DNA, 23 bp, Artificial Sequence
  Synthetic Polynucleotide
catcragcagtatgccgccctgg

SEQ ID NO: 3293 - DNA, 23 bp, Artificial Sequence
  Synthetic Polynucleotide
atcrtgctggtggtgttcttcgg

SEQ ID NO: 3294 - DNA, 23 bp, Artificial Sequence
  Synthetic Polynucleotide
cggagtacrtggtccgcctctgg

SEQ ID NO: 3295 - DNA, 23 bp, Artificial Sequence
  Synthetic Polynucleotide
gagtcagrccgcgtggagttcgg

SEQ ID NO: 3296 - DNA, 23 bp, Artificial Sequence
  Synthetic Polynucleotide
gatcgcrgcagcaacacgatcgg

SEQ ID NO: 3297 - DNA, 23 bp, Artificial Sequence
  Synthetic Polynucleotide
ggtgaacragtcaggccgcgtgg

SEQ ID NO: 3298 - DNA, 23 bp, Artificial Sequence
  Synthetic Polynucleotide
gatcrcggcagcaacacgatcgg

SEQ ID NO: 3299 - DNA, 23 bp, Artificial Sequence
  Synthetic Polynucleotide
ggatgrtacgtagcatctgaggg

SEQ ID NO: 3300 - DNA, 23 bp, Artificial Sequence
  Synthetic Polynucleotide
tggatgrtacgtagcatctgagg

SEQ ID NO: 3301 - DNA, 23 bp, Artificial Sequence
  Synthetic Polynucleotide
catcrtggtcgtggcctccatgg

SEQ ID NO: 3302 - DNA, 23 bp, Artificial Sequence
  Synthetic Polynucleotide
cgtgcraccccccagaagagcgg

SEQ ID NO: 3303 - DNA, 23 bp, Artificial Sequence
  Synthetic Polynucleotide
cccagcgrtaggtgccccgtggg

SEQ ID NO: 3304 - DNA, 23 bp, Artificial Sequence
  Synthetic Polynucleotide
tcccagcgrtaggtgccccgtgg

SEQ ID NO: 3305 - DNA, 23 bp, Artificial Sequence
  Synthetic Polynucleotide
ccccccagaagagcggyggctgg

SEQ ID NO: 3306 - DNA, 23 bp, Artificial Sequence
  Synthetic Polynucleotide
cccccagaagagcggyggctgga

SEQ ID NO: 3307 - DNA, 23 bp, Artificial Sequence
  Synthetic Polynucleotide
ccccagaagagcggyggctggac

SEQ ID NO: 3308 - DNA, 23 bp, Artificial Sequence
  Synthetic Polynucleotide
ccattaaggtcattcgaygcatg

SEQ ID NO: 3309 - DNA, 23 bp, Artificial Sequence
  Synthetic Polynucleotide
cccgcgccccctgcgtycccggc

SEQ ID NO: 3310 - DNA, 23 bp, Artificial Sequence
  Synthetic Polynucleotide
ccgcgccccctgcgtycccggcc

SEQ ID NO: 3311 - DNA, 23 bp, Artificial Sequence
  Synthetic Polynucleotide
cctcatcgtcctggtctgcytca

SEQ ID NO: 3312 - DNA, 23 bp, Artificial Sequence
  Synthetic Polynucleotide
cctccatggtggtcctctghgtg

SEQ ID NO: 3313 - DNA, 23 bp, Artificial Sequence
  Synthetic Polynucleotide
ccatggtggtcctctghgtgggc

SEQ ID NO: 3314 - DNA, 23 bp, Artificial Sequence
  Synthetic Polynucleotide
cctgaaggtgcagcagaagyaga

SEQ ID NO: 3315 - DNA, 23 bp, Artificial Sequence
  Synthetic Polynucleotide
ccaagaagaaattcyaggtaagc

SEQ ID NO: 3316 - DNA, 23 bp, Artificial Sequence
  Synthetic Polynucleotide
cccggcarcaggcctgatccagg

SEQ ID NO: 3317 - DNA, 23 bp, Artificial Sequence
  Synthetic Polynucleotide
tggaccrgcggggaggcacctgg

SEQ ID NO: 3318 - DNA, 23 bp, Artificial Sequence
  Synthetic Polynucleotide
ctggaacgrcaggctccttgcgg

SEQ ID NO: 3319 - DNA, 23 bp, Artificial Sequence
  Synthetic Polynucleotide
catccrcgtaggtgtcaaagtgg

SEQ ID NO: 3320 - DNA, 23 bp, Artificial Sequence
  Synthetic Polynucleotide
tggtrgggcctggtgagttgtgg

SEQ ID NO: 3321 - DNA, 23 bp, Artificial Sequence
  Synthetic Polynucleotide
ctacgtrtgagtggccggcgggg

SEQ ID NO: 3322 - DNA, 23 bp, Artificial Sequence
  Synthetic Polynucleotide
cctacgtrtgagtggccggcggg

SEQ ID NO: 3323 - DNA, 23 bp, Artificial Sequence
  Synthetic Polynucleotide
gcctacgtrtgagtggccggcgg

SEQ ID NO: 3324 - DNA, 23 bp, Artificial Sequence
  Synthetic Polynucleotide
tgcrgatgatccgcatggaccgg

SEQ ID NO: 3325 - DNA, 23 bp, Artificial Sequence
  Synthetic Polynucleotide
gattctgcrgatgatccgcatgg

SEQ ID NO: 3326 - DNA, 23 bp, Artificial Sequence
  Synthetic Polynucleotide
aagaggcrgaacccggcagcagg

SEQ ID NO: 3327 - DNA, 23 bp, Artificial Sequence
  Synthetic Polynucleotide
tacrcggatgcactctggtgggg

SEQ ID NO: 3328 - DNA, 23 bp, Artificial Sequence
  Synthetic Polynucleotide
ctacrcggatgcactctggtggg

SEQ ID NO: 3329 - DNA, 23 bp, Artificial Sequence
  Synthetic Polynucleotide
cctacrcggatgcactctggtgg

SEQ ID NO: 3330 - DNA, 23 bp, Artificial Sequence
  Synthetic Polynucleotide
acacctacrcggatgcactctgg

SEQ ID NO: 3331 - DNA, 23 bp, Artificial Sequence
  Synthetic Polynucleotide
ccctgaaggttcaggagyagcac

SEQ ID NO: 3332 - DNA, 23 bp, Artificial Sequence
  Synthetic Polynucleotide
cctgaaggttcaggagyagcaca

SEQ ID NO: 3333 - DNA, 23 bp, Artificial Sequence
  Synthetic Polynucleotide
cccctgtgtggatgctgcyccgg

SEQ ID NO: 3334 - DNA, 23 bp, Artificial Sequence
  Synthetic Polynucleotide
ccctgtgtggatgctgcyccgga

SEQ ID NO: 3335 - DNA, 23 bp, Artificial Sequence
  Synthetic Polynucleotide
cctgtgtggatgctgcyccggac

SEQ ID NO: 3336 - DNA, 23 bp, Artificial Sequence
  Synthetic Polynucleotide
ccacctggacatgctgtccygaa

SEQ ID NO: 3337 - DNA, 23 bp, Artificial Sequence
  Synthetic Polynucleotide
cctggacatgctgtccygaatta

SEQ ID NO: 3338 - DNA, 23 bp, Artificial Sequence
  Synthetic Polynucleotide
cccaaaacgtgggaaggcygtct

SEQ ID NO: 3339 - DNA, 23 bp, Artificial Sequence
  Synthetic Polynucleotide
ccaaaacgtgggaaggcygtctg

SEQ ID NO: 3340 - DNA, 23 bp, Artificial Sequence
  Synthetic Polynucleotide
aggctccrgctttgccctgaagg

SEQ ID NO: 3341 - DNA, 23 bp, Artificial Sequence
  Synthetic Polynucleotide
ctgrgcagggtcctggctgctgg

SEQ ID NO: 3342 - DNA, 23 bp, Artificial Sequence
  Synthetic Polynucleotide
cagcrggtcatctacctccaggg

SEQ ID NO: 3343 - DNA, 23 bp, Artificial Sequence
  Synthetic Polynucleotide
ccagcrggtcatctacctccagg

SEQ ID NO: 3344 - DNA, 23 bp, Artificial Sequence
  Synthetic Polynucleotide
cctgcrcgcctgggccgtgaagg

SEQ ID NO: 3345 - DNA, 23 bp, Artificial Sequence
  Synthetic Polynucleotide
gacctgcrgcatccagcacctgg

SEQ ID NO: 3346 - DNA, 23 bp, Artificial Sequence
  Synthetic Polynucleotide
cccacccttccaacatgygcttc

SEQ ID NO: 3347 - DNA, 23 bp, Artificial Sequence
  Synthetic Polynucleotide
ccacccttccaacatgygcttca

SEQ ID NO: 3348 - DNA, 23 bp, Artificial Sequence
  Synthetic Polynucleotide
cctggcagaagaggacyagcagg

SEQ ID NO: 3349 - DNA, 23 bp, Artificial Sequence
  Synthetic Polynucleotide
gtaccrcgtgctgcagtgccagg

SEQ ID NO: 3350 - DNA, 23 bp, Artificial Sequence
  Synthetic Polynucleotide
ccccacggactccgagggcyggt

SEQ ID NO: 3351 - DNA, 23 bp, Artificial Sequence
  Synthetic Polynucleotide
cccacggactccgagggcyggta

SEQ ID NO: 3352 - DNA, 23 bp, Artificial Sequence
  Synthetic Polynucleotide
ccacggactccgagggcyggtac

SEQ ID NO: 3353 - DNA, 23 bp, Artificial Sequence
  Synthetic Polynucleotide
cccagacggccttgtctgcyttt

SEQ ID NO: 3354 - DNA, 23 bp, Artificial Sequence
  Synthetic Polynucleotide
ccagacggccttgtctgcytttc

SEQ ID NO: 3355 - DNA, 23 bp, Artificial Sequence
  Synthetic Polynucleotide
cctgacccttcttgacctayaga

SEQ ID NO: 3356 - DNA, 23 bp, Artificial Sequence
  Synthetic Polynucleotide
cccttcttgacctayagaacaac

SEQ ID NO: 3357 - DNA, 23 bp, Artificial Sequence
  Synthetic Polynucleotide
aaattaaargttgatcttgcagg

SEQ ID NO: 3358 - DNA, 23 bp, Artificial Sequence
  Synthetic Polynucleotide
agcragcgggctgactccacggg

SEQ ID NO: 3359 - DNA, 23 bp, Artificial Sequence
  Synthetic Polynucleotide
gagcragcgggctgactccacgg

SEQ ID NO: 3360 - DNA, 23 bp, Artificial Sequence
  Synthetic Polynucleotide
agatatraatagactcctcaagg

SEQ ID NO: 3361 - DNA, 23 bp, Artificial Sequence
  Synthetic Polynucleotide
cctgctttctcaatagcaayggg

SEQ ID NO: 3362 - DNA, 23 bp, Artificial Sequence
  Synthetic Polynucleotide
atcrtgacagcaaaatgacaagg

SEQ ID NO: 3363 - DNA, 23 bp, Artificial Sequence
  Synthetic Polynucleotide
gcagrgagtgagaaggtaggggg

SEQ ID NO: 3364 - DNA, 23 bp, Artificial Sequence
  Synthetic Polynucleotide
ggcagrgagtgagaaggtagggg

SEQ ID NO: 3365 - DNA, 23 bp, Artificial Sequence
  Synthetic Polynucleotide
tggcagrgagtgagaaggtaggg

SEQ ID NO: 3366 - DNA, 23 bp, Artificial Sequence
  Synthetic Polynucleotide
ctggcagrgagtgagaaggtagg

SEQ ID NO: 3367 - DNA, 23 bp, Artificial Sequence
  Synthetic Polynucleotide
cccagaaggagacgattgygaag

SEQ ID NO: 3368 - DNA, 23 bp, Artificial Sequence
  Synthetic Polynucleotide
ccagaaggagacgattgygaagc

SEQ ID NO: 3369 - DNA, 23 bp, Artificial Sequence
  Synthetic Polynucleotide
cccagtgcgggttgccctgygag

SEQ ID NO: 3370 - DNA, 23 bp, Artificial Sequence
  Synthetic Polynucleotide
ccagtgcgggttgccctgygagt

SEQ ID NO: 3371 - DNA, 23 bp, Artificial Sequence
  Synthetic Polynucleotide
cctgggctcgcacttcygacagg

SEQ ID NO: 3372 - DNA, 23 bp, Artificial Sequence
  Synthetic Polynucleotide
ctcaagcrtaagttcctgtatgg

SEQ ID NO: 3373 - DNA, 23 bp, Artificial Sequence
  Synthetic Polynucleotide
aatggragtttcccagaaacagg

SEQ ID NO: 3374 - DNA, 23 bp, Artificial Sequence
  Synthetic Polynucleotide
tgacrctcgggcagacagatggg

SEQ ID NO: 3375 - DNA, 23 bp, Artificial Sequence
  Synthetic Polynucleotide
atgacrctcgggcagacagatgg

SEQ ID NO: 3376 - DNA, 23 bp, Artificial Sequence
  Synthetic Polynucleotide
cggcrgagcagtgtgggtgtggg

SEQ ID NO: 3377 - DNA, 23 bp, Artificial Sequence
  Synthetic Polynucleotide
gcggcrgagcagtgtgggtgtgg

SEQ ID NO: 3378 - DNA, 23 bp, Artificial Sequence
  Synthetic Polynucleotide
ccttccagaagatgcagagyagg

SEQ ID NO: 3379 - DNA, 23 bp, Artificial Sequence
  Synthetic Polynucleotide
ccagaagatgcagagyaggtgag

SEQ ID NO: 3380 - DNA, 23 bp, Artificial Sequence
  Synthetic Polynucleotide
ccttcaaacagaggcttygctgg

SEQ ID NO: 3381 - DNA, 23 bp, Artificial Sequence
  Synthetic Polynucleotide
ggctrgggtctgctggcgaacgg

SEQ ID NO: 3382 - DNA, 23 bp, Artificial Sequence
  Synthetic Polynucleotide
ccaaggacctgcagyagctcttc

SEQ ID NO: 3383 - DNA, 23 bp, Artificial Sequence
  Synthetic Polynucleotide
cccatggagcctcacagygatca

SEQ ID NO: 3384 - DNA, 23 bp, Artificial Sequence
  Synthetic Polynucleotide
ccatggagcctcacagygatcag

SEQ ID NO: 3385 - DNA, 23 bp, Artificial Sequence
  Synthetic Polynucleotide
cctacggtgggtcagcttygagc

SEQ ID NO: 3386 - DNA, 23 bp, Artificial Sequence
  Synthetic Polynucleotide
cccggggtggagagctgtyaaaa

SEQ ID NO: 3387 - DNA, 23 bp, Artificial Sequence
  Synthetic Polynucleotide
ccggggtggagagctgtyaaaac

SEQ ID NO: 3388 - DNA, 23 bp, Artificial Sequence
  Synthetic Polynucleotide
ccaaaactcccctccttccyagt

SEQ ID NO: 3389 - DNA, 23 bp, Artificial Sequence
  Synthetic Polynucleotide
cctgattcaaggcttttayagga

SEQ ID NO: 3390 - DNA, 23 bp, Artificial Sequence
  Synthetic Polynucleotide
cccatgggctctttayagcagct

SEQ ID NO: 3391 - DNA, 23 bp, Artificial Sequence
  Synthetic Polynucleotide
ccatgggctctttayagcagctt

SEQ ID NO: 3392 - DNA, 23 bp, Artificial Sequence
  Synthetic Polynucleotide
ccccacctgctggctyagccctc

SEQ ID NO: 3393 - DNA, 23 bp, Artificial Sequence
  Synthetic Polynucleotide
cccacctgctggctyagccctct

SEQ ID NO: 3394 - DNA, 23 bp, Artificial Sequence
  Synthetic Polynucleotide
ccaatctggatgtgygacagctc

SEQ ID NO: 3395 - DNA, 23 bp, Artificial Sequence
  Synthetic Polynucleotide
ccaggagccaccccctgccyagg

SEQ ID NO: 3396 - DNA, 23 bp, Artificial Sequence
  Synthetic Polynucleotide
caagrtgcgtgccctggaggagg

SEQ ID NO: 3397 - DNA, 23 bp, Artificial Sequence
  Synthetic Polynucleotide
ggacaagrtgcgtgccctggagg

SEQ ID NO: 3398 - DNA, 23 bp, Artificial Sequence
  Synthetic Polynucleotide
agggcraggagtgcaggtgaggg

SEQ ID NO: 3399 - DNA, 23 bp, Artificial Sequence
  Synthetic Polynucleotide
gagggcraggagtgcaggtgagg

SEQ ID NO: 3400 - DNA, 23 bp, Artificial Sequence
  Synthetic Polynucleotide
tgccragcagcgtggggagctgg

SEQ ID NO: 3401 - DNA, 23 bp, Artificial Sequence
  Synthetic Polynucleotide
ccgcctctgccatcacccygtct

SEQ ID NO: 3402 - DNA, 23 bp, Artificial Sequence
  Synthetic Polynucleotide
cctctgccatcacccygtctgtc

SEQ ID NO: 3403 - DNA, 23 bp, Artificial Sequence
  Synthetic Polynucleotide
ggagggtraggagtgcaggtggg

SEQ ID NO: 3404 - DNA, 23 bp, Artificial Sequence
  Synthetic Polynucleotide
tggagggtraggagtgcaggtgg

SEQ ID NO: 3405 - DNA, 23 bp, Artificial Sequence
  Synthetic Polynucleotide
ggagggcraggagtgcaggtggg

SEQ ID NO: 3406 - DNA, 23 bp, Artificial Sequence
  Synthetic Polynucleotide
tggagggcraggagtgcaggtgg

SEQ ID NO: 3407 - DNA, 23 bp, Artificial Sequence
  Synthetic Polynucleotide
cctacctgcactcctygccctcc

SEQ ID NO: 3408 - DNA, 23 bp, Artificial Sequence
  Synthetic Polynucleotide
atatcragatcgccacctacagg

SEQ ID NO: 3409 - DNA, 23 bp, Artificial Sequence
  Synthetic Polynucleotide
taagrtgcaggctctagaggagg

SEQ ID NO: 3410 - DNA, 23 bp, Artificial Sequence
  Synthetic Polynucleotide
ggataagrtgcaggctctagagg

SEQ ID NO: 3411 - DNA, 23 bp, Artificial Sequence
  Synthetic Polynucleotide
actgratgtggtggagagtaggg

SEQ ID NO: 3412 - DNA, 23 bp, Artificial Sequence
  Synthetic Polynucleotide
aactgratgtggtggagagtagg

SEQ ID NO: 3413 - DNA, 23 bp, Artificial Sequence
  Synthetic Polynucleotide
atcaacrggatccctgtggaggg

SEQ ID NO: 3414 - DNA, 23 bp, Artificial Sequence
  Synthetic Polynucleotide
aatcaacrggatccctgtggagg

SEQ ID NO: 3415 - DNA, 23 bp, Artificial Sequence
  Synthetic Polynucleotide
cgcrtgcagtggcgccctcaggg

SEQ ID NO: 3416 - DNA, 23 bp, Artificial Sequence
  Synthetic Polynucleotide
ccgcrtgcagtggcgccctcagg

SEQ ID NO: 3417 - DNA, 23 bp, Artificial Sequence
  Synthetic Polynucleotide
tcgttgrtggcggaattgtgggg

SEQ ID NO: 3418 - DNA, 23 bp, Artificial Sequence
  Synthetic Polynucleotide
atcgttgrtggcggaattgtggg

SEQ ID NO: 3419 - DNA, 23 bp, Artificial Sequence
  Synthetic Polynucleotide
catcgttgrtggcggaattgtgg

SEQ ID NO: 3420 - DNA, 23 bp, Artificial Sequence
  Synthetic Polynucleotide
acagatrtcagagttcctactgg

SEQ ID NO: 3421 - DNA, 23 bp, Artificial Sequence
  Synthetic Polynucleotide
aagagrtacagtcgaggcatggg

SEQ ID NO: 3422 - DNA, 23 bp, Artificial Sequence
  Synthetic Polynucleotide
aaagagrtacagtcgaggcatgg

SEQ ID NO: 3423 - DNA, 23 bp, Artificial Sequence
  Synthetic Polynucleotide
gcarcctgtcgctgtaatgccgg

SEQ ID NO: 3424 - DNA, 23 bp, Artificial Sequence
  Synthetic Polynucleotide
tcaratgacctcaagcagtttgg

SEQ ID NO: 3425 - DNA, 23 bp, Artificial Sequence
  Synthetic Polynucleotide
ccagtattccgttcygaggttgc

SEQ ID NO: 3426 - DNA, 23 bp, Artificial Sequence
  Synthetic Polynucleotide
ccacctaggagaaaaygaaggca

SEQ ID NO: 3427 - DNA, 23 bp, Artificial Sequence
  Synthetic Polynucleotide
ccgttcatgtagagygaactaga

SEQ ID NO: 3428 - DNA, 23 bp, Artificial Sequence
  Synthetic Polynucleotide
ccatagaactgtgaccygagaag

SEQ ID NO: 3429 - DNA, 23 bp, Artificial Sequence
  Synthetic Polynucleotide
ccaaaggctgtcttyagaaaagc

SEQ ID NO: 3430 - DNA, 23 bp, Artificial Sequence
  Synthetic Polynucleotide
ccaatctcacaactctcygagat

SEQ ID NO: 3431 - DNA, 23 bp, Artificial Sequence
  Synthetic Polynucleotide
ccaatcatggagccctcyagttt

SEQ ID NO: 3432 - DNA, 23 bp, Artificial Sequence
  Synthetic Polynucleotide
ccgtgggcagggctgygatgtga

SEQ ID NO: 3433 - DNA, 23 bp, Artificial Sequence
  Synthetic Polynucleotide
ccagcgggcacttggcaagytct

SEQ ID NO: 3434 - DNA, 23 bp, Artificial Sequence
  Synthetic Polynucleotide
gtgrtcagggcctgggctggagg

SEQ ID NO: 3435 - DNA, 23 bp, Artificial Sequence
  Synthetic Polynucleotide
cctgtgrtcagggcctgggctgg

SEQ ID NO: 3436 - DNA, 23 bp, Artificial Sequence
  Synthetic Polynucleotide
cctactatgctgtgtccyagctc

SEQ ID NO: 3437 - DNA, 23 bp, Artificial Sequence
  Synthetic Polynucleotide
ccgccagggtcggcctyagagct

SEQ ID NO: 3438 - DNA, 23 bp, Artificial Sequence
  Synthetic Polynucleotide
ccaactctgtttcctttyccacc

SEQ ID NO: 3439 - DNA, 23 bp, Artificial Sequence
  Synthetic Polynucleotide
ccagccctgtgactgcyagtcgg

SEQ ID NO: 3440 - DNA, 23 bp, Artificial Sequence
  Synthetic Polynucleotide
ggctccrgtaagcaaagcactgg

SEQ ID NO: 3441 - DNA, 23 bp, Artificial Sequence
  Synthetic Polynucleotide
ccacacccgctccgagyagtgct

SEQ ID NO: 3442 - DNA, 23 bp, Artificial Sequence
  Synthetic Polynucleotide
cctgttcatgcaaaaaygaaaga

SEQ ID NO: 3443 - DNA, 23 bp, Artificial Sequence
  Synthetic Polynucleotide
cccacagggtacctgcacayact

SEQ ID NO: 3444 - DNA, 23 bp, Artificial Sequence
  Synthetic Polynucleotide
ccacagggtacctgcacayactg

SEQ ID NO: 3445 - DNA, 23 bp, Artificial Sequence
  Synthetic Polynucleotide
ccagcaggaggagtactacygca

SEQ ID NO: 3446 - DNA, 23 bp, Artificial Sequence
  Synthetic Polynucleotide
tgcratttccccgtggaggctgg

SEQ ID NO: 3447 - DNA, 23 bp, Artificial Sequence
  Synthetic Polynucleotide
tggctgcratttccccgtggagg

SEQ ID NO: 3448 - DNA, 23 bp, Artificial Sequence
  Synthetic Polynucleotide
ccaaaagccctgccgggctygag

SEQ ID NO: 3449 - DNA, 23 bp, Artificial Sequence
  Synthetic Polynucleotide
cccacgttttgccaaattgygca

SEQ ID NO: 3450 - DNA, 23 bp, Artificial Sequence
  Synthetic Polynucleotide
ccacgttttgccaaattgygcaa

SEQ ID NO: 3451 - DNA, 23 bp, Artificial Sequence
  Synthetic Polynucleotide
cctgtactcggcagagaycctga

SEQ ID NO: 3452 - DNA, 23 bp, Artificial Sequence
  Synthetic Polynucleotide
ctgcccgracggcatgctgctgg

SEQ ID NO: 3453 - DNA, 23 bp, Artificial Sequence
  Synthetic Polynucleotide
gcgaaratggctcggatgagtgg

SEQ ID NO: 3454 - DNA, 23 bp, Artificial Sequence
  Synthetic Polynucleotide
ggacgrctacagctacccctcgg

SEQ ID NO: 3455 - DNA, 23 bp, Artificial Sequence
  Synthetic Polynucleotide
gacraattccagtgctctgatgg

SEQ ID NO: 3456 - DNA, 23 bp, Artificial Sequence
  Synthetic Polynucleotide
gaaaggggrcctgaatggtgtgg

SEQ ID NO: 3457 - DNA, 23 bp, Artificial Sequence
  Synthetic Polynucleotide
ccccracggcttccagctggtgg

SEQ ID NO: 3458 - DNA, 23 bp, Artificial Sequence
  Synthetic Polynucleotide
gtgccccracggcttccagctgg

SEQ ID NO: 3459 - DNA, 23 bp, Artificial Sequence
  Synthetic Polynucleotide
ctgcaagracaaatctgacgagg

SEQ ID NO: 3460 - DNA, 23 bp, Artificial Sequence
  Synthetic Polynucleotide
cccgactgcgaagatggctygga

SEQ ID NO: 3461 - DNA, 23 bp, Artificial Sequence
  Synthetic Polynucleotide
ccgactgcgaagatggctyggat

SEQ ID NO: 3462 - DNA, 23 bp, Artificial Sequence
  Synthetic Polynucleotide
ccactgcctaagtggygagtgca

SEQ ID NO: 3463 - DNA, 23 bp, Artificial Sequence
  Synthetic Polynucleotide
cccccagctgtgggcctghgaca

SEQ ID NO: 3464 - DNA, 23 bp, Artificial Sequence
  Synthetic Polynucleotide
ccccagctgtgggcctghgacaa

SEQ ID NO: 3465 - DNA, 23 bp, Artificial Sequence
  Synthetic Polynucleotide
cccagctgtgggcctghgacaac

SEQ ID NO: 3466 - DNA, 23 bp, Artificial Sequence
  Synthetic Polynucleotide
ccagctgtgggcctghgacaacg

SEQ ID NO: 3467 - DNA, 23 bp, Artificial Sequence
  Synthetic Polynucleotide
agagctrggggggcggtggccgg

SEQ ID NO: 3468 - DNA, 23 bp, Artificial Sequence
  Synthetic Polynucleotide
ggtcarcctgcccaacatgaggg

SEQ ID NO: 3469 - DNA, 23 bp, Artificial Sequence
  Synthetic Polynucleotide
tggtcarcctgcccaacatgagg

SEQ ID NO: 3470 - DNA, 23 bp, Artificial Sequence
  Synthetic Polynucleotide
ccatttctggggccgygacagtg

SEQ ID NO: 3471 - DNA, 23 bp, Artificial Sequence
  Synthetic Polynucleotide
tgccgrctactgccccaccatgg

SEQ ID NO: 3472 - DNA, 23 bp, Artificial Sequence
  Synthetic Polynucleotide
ccagaaccgccgggycaaggaga

SEQ ID NO: 3473 - DNA, 23 bp, Artificial Sequence
  Synthetic Polynucleotide
cctgctgccctgacaggygcttc

SEQ ID NO: 3474 - DNA, 23 bp, Artificial Sequence
  Synthetic Polynucleotide
cctgcraatacaaatatgacggg

SEQ ID NO: 3475 - DNA, 23 bp, Artificial Sequence
  Synthetic Polynucleotide
acctgcraatacaaatatgacgg

SEQ ID NO: 3476 - DNA, 23 bp, Artificial Sequence
  Synthetic Polynucleotide
cctgggccgggggaagygggccg

SEQ ID NO: 3477 - DNA, 23 bp, Artificial Sequence
  Synthetic Polynucleotide
gttggagratattggggtaaagg

SEQ ID NO: 3478 - DNA, 23 bp, Artificial Sequence
  Synthetic Polynucleotide
cctctcagtatgtttygacgcca

SEQ ID NO: 3479 - DNA, 23 bp, Artificial Sequence
  Synthetic Polynucleotide
cctggaatgcctacytggctcca

SEQ ID NO: 3480 - DNA, 23 bp, Artificial Sequence
  Synthetic Polynucleotide
ataacgccrgtgctctgacctgg

SEQ ID NO: 3481 - DNA, 23 bp, Artificial Sequence
  Synthetic Polynucleotide
ccgcgaaccacatcagcyagtcc

SEQ ID NO: 3482 - DNA, 23 bp, Artificial Sequence
  Synthetic Polynucleotide
gcgcgrtgagttcgcccaggtgg

SEQ ID NO: 3483 - DNA, 23 bp, Artificial Sequence
  Synthetic Polynucleotide
aaagcgcgrtgagttcgcccagg

SEQ ID NO: 3484 - DNA, 23 bp, Artificial Sequence
  Synthetic Polynucleotide
gtcacccrctcctacctcctggg

SEQ ID NO: 3485 - DNA, 23 bp, Artificial Sequence
  Synthetic Polynucleotide
ggtcacccrctcctacctcctgg

SEQ ID NO: 3486 - DNA, 23 bp, Artificial Sequence
  Synthetic Polynucleotide
gcgcrtggccgtggaggaggtgg

SEQ ID NO: 3487 - DNA, 23 bp, Artificial Sequence
  Synthetic Polynucleotide
cgggcgcrtggccgtggaggagg

SEQ ID NO: 3488 - DNA, 23 bp, Artificial Sequence
  Synthetic Polynucleotide
acgrctctcatcaactccactgg

SEQ ID NO: 3489 - DNA, 23 bp, Artificial Sequence
  Synthetic Polynucleotide
gtgrgcggacccatctcctctgg

SEQ ID NO: 3490 - DNA, 23 bp, Artificial Sequence
  Synthetic Polynucleotide
agatggccragatgcgggcaagg

SEQ ID NO: 3491 - DNA, 23 bp, Artificial Sequence
  Synthetic Polynucleotide
atgagrtaggctcctgctcaggg

SEQ ID NO: 3492 - DNA, 23 bp, Artificial Sequence
  Synthetic Polynucleotide
aatgagrtaggctcctgctcagg

SEQ ID NO: 3493 - DNA, 23 bp, Artificial Sequence
  Synthetic Polynucleotide
ggcrggtggatgctgagaacagg

SEQ ID NO: 3494 - DNA, 23 bp, Artificial Sequence
  Synthetic Polynucleotide
gagrtgggctggggagacgtcgg

SEQ ID NO: 3495 - DNA, 23 bp, Artificial Sequence
  Synthetic Polynucleotide
gaartaagtaggcctgggcctgg

SEQ ID NO: 3496 - DNA, 23 bp, Artificial Sequence
  Synthetic Polynucleotide
ctggggaartaagtaggcctggg

SEQ ID NO: 3497 - DNA, 23 bp, Artificial Sequence
  Synthetic Polynucleotide
acgrtgagtggcagggcgcttgg

SEQ ID NO: 3498 - DNA, 23 bp, Artificial Sequence
  Synthetic Polynucleotide
cgcctacraggccgagctcgggg

SEQ ID NO: 3499 - DNA, 23 bp, Artificial Sequence
  Synthetic Polynucleotide
ccgcctacraggccgagctcggg

SEQ ID NO: 3500 - DNA, 23 bp, Artificial Sequence
  Synthetic Polynucleotide
ctgcvggaacagcctgcgtacgg

SEQ ID NO: 3501 - DNA, 23 bp, Artificial Sequence
  Synthetic Polynucleotide
ggcragctgcatgatctgcgggg

SEQ ID NO: 3502 - DNA, 23 bp, Artificial Sequence
  Synthetic Polynucleotide
gggcragctgcatgatctgcggg

SEQ ID NO: 3503 - DNA, 23 bp, Artificial Sequence
  Synthetic Polynucleotide
agggcragctgcatgatctgcgg

SEQ ID NO: 3504 - DNA, 23 bp, Artificial Sequence
  Synthetic Polynucleotide
ccgcaagctcttggagggygagg

SEQ ID NO: 3505 - DNA, 23 bp, Artificial Sequence
  Synthetic Polynucleotide
ccaacccttccaggagctgygtg

SEQ ID NO: 3506 - DNA, 23 bp, Artificial Sequence
  Synthetic Polynucleotide
cccttccaggagctgygtgagac

SEQ ID NO: 3507 - DNA, 23 bp, Artificial Sequence
  Synthetic Polynucleotide
ccttccaggagctgygtgagacc

SEQ ID NO: 3508 - DNA, 23 bp, Artificial Sequence
  Synthetic Polynucleotide
cccactgcagcagctygggggac

SEQ ID NO: 3509 - DNA, 23 bp, Artificial Sequence
  Synthetic Polynucleotide
ccactgcagcagctygggggacc

SEQ ID NO: 3510 - DNA, 23 bp, Artificial Sequence
  Synthetic Polynucleotide
ccctgaaggctgggyaggtggtg

SEQ ID NO: 3511 - DNA, 23 bp, Artificial Sequence
  Synthetic Polynucleotide
ccctacctcgcagcgcagcygtg

SEQ ID NO: 3512 - DNA, 23 bp, Artificial Sequence
  Synthetic Polynucleotide
cctacctcgcagcgcagcygtgg

SEQ ID NO: 3513 - DNA, 23 bp, Artificial Sequence
  Synthetic Polynucleotide
cctcgcagcgcagcygtggccgt

SEQ ID NO: 3514 - DNA, 23 bp, Artificial Sequence
  Synthetic Polynucleotide
cccttgctgacttacyggttccc

SEQ ID NO: 3515 - DNA, 23 bp, Artificial Sequence
  Synthetic Polynucleotide
ccttgctgacttacyggttccca

SEQ ID NO: 3516 - DNA, 23 bp, Artificial Sequence
  Synthetic Polynucleotide
ccaaggaggcgaagcttygagac

SEQ ID NO: 3517 - DNA, 23 bp, Artificial Sequence
  Synthetic Polynucleotide
ccggctggcggatgcgctgyagg

SEQ ID NO: 3518 - DNA, 23 bp, Artificial Sequence
  Synthetic Polynucleotide
ccgtcccagcggcgcgccayccg

SEQ ID NO: 3519 - DNA, 23 bp, Artificial Sequence
  Synthetic Polynucleotide
cccagcggcgcgccayccgcagc

SEQ ID NO: 3520 - DNA, 23 bp, Artificial Sequence
  Synthetic Polynucleotide
ccagcggcgcgccayccgcagcg

SEQ ID NO: 3521 - DNA, 23 bp, Artificial Sequence
  Synthetic Polynucleotide
ccatggagaccccgtccyagcgg

SEQ ID NO: 3522 - DNA, 23 bp, Artificial Sequence
  Synthetic Polynucleotide
cccgcggaggcccaagygacccc

SEQ ID NO: 3523 - DNA, 23 bp, Artificial Sequence
  Synthetic Polynucleotide
ccgcggaggcccaagygaccccg

SEQ ID NO: 3524 - DNA, 23 bp, Artificial Sequence
  Synthetic Polynucleotide
cctcaccacgcagcagygaagag

SEQ ID NO: 3525 - DNA, 23 bp, Artificial Sequence
  Synthetic Polynucleotide
cctctctctgagccaggtcygag

SEQ ID NO: 3526 - DNA, 23 bp, Artificial Sequence
  Synthetic Polynucleotide
atcrctccccagtgtccccgagg

SEQ ID NO: 3527 - DNA, 23 bp, Artificial Sequence
  Synthetic Polynucleotide
ccgttttagataaaygaagccga

SEQ ID NO: 3528 - DNA, 23 bp, Artificial Sequence
  Synthetic Polynucleotide
gagttrggtgccaaaacttgtgg

SEQ ID NO: 3529 - DNA, 23 bp, Artificial Sequence
  Synthetic Polynucleotide
ttgraatccagaaaccagttggg

SEQ ID NO: 3530 - DNA, 23 bp, Artificial Sequence
  Synthetic Polynucleotide
attgraatccagaaaccagttgg

SEQ ID NO: 3531 - DNA, 23 bp, Artificial Sequence
  Synthetic Polynucleotide
ccaaactggtgggayaggatgtg

SEQ ID NO: 3532 - DNA, 23 bp, Artificial Sequence
  Synthetic Polynucleotide
caaatrtaaggccaaaaatctgg

SEQ ID NO: 3533 - DNA, 23 bp, Artificial Sequence
  Synthetic Polynucleotide
ccaccatggccaacaagygatca

SEQ ID NO: 3534 - DNA, 23 bp, Artificial Sequence
  Synthetic Polynucleotide
ccatggccaacaagygatcattc

SEQ ID NO: 3535 - DNA, 23 bp, Artificial Sequence
  Synthetic Polynucleotide
ccagtacaatcgtgaagcaytaa

SEQ ID NO: 3536 - DNA, 23 bp, Artificial Sequence
  Synthetic Polynucleotide
ccagaagtgtgaaagcygacctg

SEQ ID NO: 3537 - DNA, 23 bp, Artificial Sequence
  Synthetic Polynucleotide
ggaccractcaggcacctcgagg

SEQ ID NO: 3538 - DNA, 23 bp, Artificial Sequence
  Synthetic Polynucleotide
gaagctrcattgctgagcattgg

SEQ ID NO: 3539 - DNA, 23 bp, Artificial Sequence
  Synthetic Polynucleotide
ccagtacccttgtcagcayggtg

SEQ ID NO: 3540 - DNA, 23 bp, Artificial Sequence
  Synthetic Polynucleotide
cgagcrggtgcacaaggtcaagg

SEQ ID NO: 3541 - DNA, 23 bp, Artificial Sequence
  Synthetic Polynucleotide
cttcrccctgacgctctccgggg

SEQ ID NO: 3542 - DNA, 23 bp, Artificial Sequence
  Synthetic Polynucleotide
ccttcrccctgacgctctccggg

SEQ ID NO: 3543 - DNA, 23 bp, Artificial Sequence
  Synthetic Polynucleotide
cccttcrccctgacgctctccgg

SEQ ID NO: 3544 - DNA, 23 bp, Artificial Sequence
  Synthetic Polynucleotide
ccgcacatttttgggttcaygct

SEQ ID NO: 3545 - DNA, 23 bp, Artificial Sequence
  Synthetic Polynucleotide
ccatcgactacgaccygctagag

SEQ ID NO: 3546 - DNA, 23 bp, Artificial Sequence
  Synthetic Polynucleotide
ccccttcgccctgaygctctccg

SEQ ID NO: 3547 - DNA, 23 bp, Artificial Sequence
  Synthetic Polynucleotide
ccgcatcgaggtgacgygcctca

SEQ ID NO: 3548 - DNA, 23 bp, Artificial Sequence
  Synthetic Polynucleotide
cccgttcggtctgacgyagtaca

SEQ ID NO: 3549 - DNA, 23 bp, Artificial Sequence
  Synthetic Polynucleotide
ccgttcggtctgacgyagtacag

SEQ ID NO: 3550 - DNA, 23 bp, Artificial Sequence
  Synthetic Polynucleotide
attgagcragcagctctggatgg

SEQ ID NO: 3551 - DNA, 23 bp, Artificial Sequence
  Synthetic Polynucleotide
tgcragtacttgagccacatggg

SEQ ID NO: 3552 - DNA, 23 bp, Artificial Sequence
  Synthetic Polynucleotide
ctgcragtacttgagccacatgg

SEQ ID NO: 3553 - DNA, 23 bp, Artificial Sequence
  Synthetic Polynucleotide
gctrcacccagggcgctagctgg

SEQ ID NO: 3554 - DNA, 23 bp, Artificial Sequence
  Synthetic Polynucleotide
agatrtgaatgagtgcatggggg

SEQ ID NO: 3555 - DNA, 23 bp, Artificial Sequence
  Synthetic Polynucleotide
cagatrtgaatgagtgcatgggg

SEQ ID NO: 3556 - DNA, 23 bp, Artificial Sequence
  Synthetic Polynucleotide
gcagatrtgaatgagtgcatggg

SEQ ID NO: 3557 - DNA, 23 bp, Artificial Sequence
  Synthetic Polynucleotide
tgcagatrtgaatgagtgcatgg

SEQ ID NO: 3558 - DNA, 23 bp, Artificial Sequence
  Synthetic Polynucleotide
ccgtcccgcgcgcagyagtcgcg

SEQ ID NO: 3559 - DNA, 23 bp, Artificial Sequence
  Synthetic Polynucleotide
cccagcagcacccaggcctygag

SEQ ID NO: 3560 - DNA, 23 bp, Artificial Sequence
  Synthetic Polynucleotide
ccagcagcacccaggcctygagg

SEQ ID NO: 3561 - DNA, 23 bp, Artificial Sequence
  Synthetic Polynucleotide
cctgggccaggagccacccygag

SEQ ID NO: 3562 - DNA, 23 bp, Artificial Sequence
  Synthetic Polynucleotide
aatratgccagagcattagaagg

SEQ ID NO: 3563 - DNA, 23 bp, Artificial Sequence
  Synthetic Polynucleotide
cctcacttcaaagtataygactt

SEQ ID NO: 3564 - DNA, 23 bp, Artificial Sequence
  Synthetic Polynucleotide
cgcrgagccgctggcttcgcagg

SEQ ID NO: 3565 - DNA, 23 bp, Artificial Sequence
  Synthetic Polynucleotide
ccccccgttaccaccactyggcc

SEQ ID NO: 3566 - DNA, 23 bp, Artificial Sequence
  Synthetic Polynucleotide
cccccgttaccaccactyggccg

SEQ ID NO: 3567 - DNA, 23 bp, Artificial Sequence
  Synthetic Polynucleotide
ccccgttaccaccactyggccgt

SEQ ID NO: 3568 - DNA, 23 bp, Artificial Sequence
  Synthetic Polynucleotide
cccgttaccaccactyggccgtc

SEQ ID NO: 3569 - DNA, 23 bp, Artificial Sequence
  Synthetic Polynucleotide
ccgttaccaccactyggccgtcg

SEQ ID NO: 3570 - DNA, 23 bp, Artificial Sequence
  Synthetic Polynucleotide
cctgcagccagccggctyggtgt

SEQ ID NO: 3571 - DNA, 23 bp, Artificial Sequence
  Synthetic Polynucleotide
ccgtgccctcgtcgyccagcttc

SEQ ID NO: 3572 - DNA, 23 bp, Artificial Sequence
  Synthetic Polynucleotide
ccgtgccctcgtcgcycagcttc

SEQ ID NO: 3573 - DNA, 23 bp, Artificial Sequence
  Synthetic Polynucleotide
ccaagccaaggtgcctgtcyagc

SEQ ID NO: 3574 - DNA, 23 bp, Artificial Sequence
  Synthetic Polynucleotide
ccaaggtgcctgtcyagcgctcg

SEQ ID NO: 3575 - DNA, 23 bp, Artificial Sequence
  Synthetic Polynucleotide
cctggcaaactcctggygatact

SEQ ID NO: 3576 - DNA, 23 bp, Artificial Sequence
  Synthetic Polynucleotide
ccttccaccagtaagyagatagt

SEQ ID NO: 3577 - DNA, 23 bp, Artificial Sequence
  Synthetic Polynucleotide
cctgtttgagagcacgatcygca

SEQ ID NO: 3578 - DNA, 23 bp, Artificial Sequence
  Synthetic Polynucleotide
tgggrtgagtggcacaggctggg

SEQ ID NO: 3579 - DNA, 23 bp, Artificial Sequence
  Synthetic Polynucleotide
gtgggrtgagtggcacaggctgg

SEQ ID NO: 3580 - DNA, 23 bp, Artificial Sequence
  Synthetic Polynucleotide
tccagrtacaacgccagtatagg

SEQ ID NO: 3581 - DNA, 23 bp, Artificial Sequence
  Synthetic Polynucleotide
cctgctgcctgttcgcyagacct

SEQ ID NO: 3582 - DNA, 23 bp, Artificial Sequence
  Synthetic Polynucleotide
tggcragatcagtatctgcatgg

SEQ ID NO: 3583 - DNA, 23 bp, Artificial Sequence
  Synthetic Polynucleotide
cctgagcaaggtgacctycaagt

SEQ ID NO: 3584 - DNA, 23 bp, Artificial Sequence
  Synthetic Polynucleotide
ccctgctgacatctggygcttct

SEQ ID NO: 3585 - DNA, 23 bp, Artificial Sequence
  Synthetic Polynucleotide
cctgctgacatctggygcttcta

SEQ ID NO: 3586 - DNA, 23 bp, Artificial Sequence
  Synthetic Polynucleotide
ccgcaccacggaggccyggcacc

SEQ ID NO: 3587 - DNA, 23 bp, Artificial Sequence
  Synthetic Polynucleotide
cctgaggccaaggtcaccyagca

SEQ ID NO: 3588 - DNA, 23 bp, Artificial Sequence
  Synthetic Polynucleotide
ccacatcattcggaaagcygaca

SEQ ID NO: 3589 - DNA, 23 bp, Artificial Sequence
  Synthetic Polynucleotide
cactggccrtaagattattgtgg

SEQ ID NO: 3590 - DNA, 23 bp, Artificial Sequence
  Synthetic Polynucleotide
cctggccrcgcccgcggtgcagg

SEQ ID NO: 3591 - DNA, 23 bp, Artificial Sequence
  Synthetic Polynucleotide
aagrtgagcacccgagctcgtgg

SEQ ID NO: 3592 - DNA, 23 bp, Artificial Sequence
  Synthetic Polynucleotide
atgrcaccaagggagaaaagggg

SEQ ID NO: 3593 - DNA, 23 bp, Artificial Sequence
  Synthetic Polynucleotide
gatgrcaccaagggagaaaaggg

SEQ ID NO: 3594 - DNA, 23 bp, Artificial Sequence
  Synthetic Polynucleotide
tgatgrcaccaagggagaaaagg

SEQ ID NO: 3595 - DNA, 23 bp, Artificial Sequence
  Synthetic Polynucleotide
cccaggcaaagatgggygtgatg

SEQ ID NO: 3596 - DNA, 23 bp, Artificial Sequence
  Synthetic Polynucleotide
ccaggcaaagatgggygtgatgg

SEQ ID NO: 3597 - DNA, 23 bp, Artificial Sequence
  Synthetic Polynucleotide
cctgagrtgtttgtgactctggg

SEQ ID NO: 3598 - DNA, 23 bp, Artificial Sequence
  Synthetic Polynucleotide
tcctgagrtgtttgtgactctgg

SEQ ID NO: 3599 - DNA, 23 bp, Artificial Sequence
  Synthetic Polynucleotide
tggrcagcttgcacggtttcagg

SEQ ID NO: 3600 - DNA, 23 bp, Artificial Sequence
  Synthetic Polynucleotide
ccacatgttcctgatggycaggc

SEQ ID NO: 3601 - DNA, 23 bp, Artificial Sequence
  Synthetic Polynucleotide
ccttggtaatgtttcttyctgtt

SEQ ID NO: 3602 - DNA, 23 bp, Artificial Sequence
  Synthetic Polynucleotide
tacrtattcagcccgggctgtgg

SEQ ID NO: 3603 - DNA, 23 bp, Artificial Sequence
  Synthetic Polynucleotide
taaggagrtaggtctggcagtgg

SEQ ID NO: 3604 - DNA, 23 bp, Artificial Sequence
  Synthetic Polynucleotide
cctaatgattttgacttcayggt

SEQ ID NO: 3605 - DNA, 23 bp, Artificial Sequence
  Synthetic Polynucleotide
cccctcccggcgagagyagaaac

SEQ ID NO: 3606 - DNA, 23 bp, Artificial Sequence
  Synthetic Polynucleotide
ccctcccggcgagagyagaaacc

SEQ ID NO: 3607 - DNA, 23 bp, Artificial Sequence
  Synthetic Polynucleotide
cctcccggcgagagyagaaacca

SEQ ID NO: 3608 - DNA, 23 bp, Artificial Sequence
  Synthetic Polynucleotide
ccacgtcagagggtgtgyaggtg

SEQ ID NO: 3609 - DNA, 23 bp, Artificial Sequence
  Synthetic Polynucleotide
ccaccacatccaccyaggtcatg

SEQ ID NO: 3610 - DNA, 23 bp, Artificial Sequence
  Synthetic Polynucleotide
ccagcccccctgagcccyaggac

SEQ ID NO: 3611 - DNA, 23 bp, Artificial Sequence
  Synthetic Polynucleotide
catgrgatgaaccggtccgatgg

SEQ ID NO: 3612 - DNA, 23 bp, Artificial Sequence
  Synthetic Polynucleotide
cccccaggaccccctggcgyccc

SEQ ID NO: 3613 - DNA, 23 bp, Artificial Sequence
  Synthetic Polynucleotide
ccccaggaccccctggcgycccc

SEQ ID NO: 3614 - DNA, 23 bp, Artificial Sequence
  Synthetic Polynucleotide
cccaggaccccctggcgycccca

SEQ ID NO: 3615 - DNA, 23 bp, Artificial Sequence
  Synthetic Polynucleotide
ccaggaccccctggcgyccccaa

SEQ ID NO: 3616 - DNA, 23 bp, Artificial Sequence
  Synthetic Polynucleotide
tggargtgagagagcatgcgtgg

SEQ ID NO: 3617 - DNA, 23 bp, Artificial Sequence
  Synthetic Polynucleotide
ccgtaaaccagatctcygagttc

SEQ ID NO: 3618 - DNA, 23 bp, Artificial Sequence
  Synthetic Polynucleotide
cctggtgtaacacatygacctcc

SEQ ID NO: 3619 - DNA, 23 bp, Artificial Sequence
  Synthetic Polynucleotide
ccgccrttactgggaggtggagg

SEQ ID NO: 3620 - DNA, 23 bp, Artificial Sequence
  Synthetic Polynucleotide
tggccgccrttactgggaggtgg

SEQ ID NO: 3621 - DNA, 23 bp, Artificial Sequence
  Synthetic Polynucleotide
gatraaggaaaatgagtaccagg

SEQ ID NO: 3622 - DNA, 23 bp, Artificial Sequence
  Synthetic Polynucleotide
cctggagcagcaagagyatttct

SEQ ID NO: 3623 - DNA, 23 bp, Artificial Sequence
  Synthetic Polynucleotide
ctgrcacggcaagggcaacgagg

SEQ ID NO: 3624 - DNA, 23 bp, Artificial Sequence
  Synthetic Polynucleotide
ctacvacggcatctgcaaatggg

SEQ ID NO: 3625 - DNA, 23 bp, Artificial Sequence
  Synthetic Polynucleotide
tctacvacggcatctgcaaatgg

SEQ ID NO: 3626 - DNA, 23 bp, Artificial Sequence
  Synthetic Polynucleotide
gtccarggcacccagagccaagg

SEQ ID NO: 3627 - DNA, 23 bp, Artificial Sequence
  Synthetic Polynucleotide
ggcatctrcaaatgggaggaggg

SEQ ID NO: 3628 - DNA, 23 bp, Artificial Sequence
  Synthetic Polynucleotide
cggcatctrcaaatgggaggagg

SEQ ID NO: 3629 - DNA, 23 bp, Artificial Sequence
  Synthetic Polynucleotide
aagrtgggggcatctaaggaggg

SEQ ID NO: 3630 - DNA, 23 bp, Artificial Sequence
  Synthetic Polynucleotide
caagrtgggggcatctaaggagg

SEQ ID NO: 3631 - DNA, 23 bp, Artificial Sequence
  Synthetic Polynucleotide
ccacaagrtgggggcatctaagg

SEQ ID NO: 3632 - DNA, 23 bp, Artificial Sequence
  Synthetic Polynucleotide
tgctgccdagctgggccgagagg

SEQ ID NO: 3633 - DNA, 23 bp, Artificial Sequence
  Synthetic Polynucleotide
cccagaagacgctgttccygctg

SEQ ID NO: 3634 - DNA, 23 bp, Artificial Sequence
  Synthetic Polynucleotide
ccagaagacgctgttccygctgc

SEQ ID NO: 3635 - DNA, 23 bp, Artificial Sequence
  Synthetic Polynucleotide
ccggtgtggctgagygggtattg

SEQ ID NO: 3636 - DNA, 23 bp, Artificial Sequence
  Synthetic Polynucleotide
ccagtgctcactttcyagagtga

SEQ ID NO: 3637 - DNA, 23 bp, Artificial Sequence
  Synthetic Polynucleotide
cctgtccctctatcctygagaag

SEQ ID NO: 3638 - DNA, 23 bp, Artificial Sequence
  Synthetic Polynucleotide
ccacctttcttgtgyagtcccta

SEQ ID NO: 3639 - DNA, 23 bp, Artificial Sequence
  Synthetic Polynucleotide
ccacccaaatgtcattygacttc

SEQ ID NO: 3640 - DNA, 23 bp, Artificial Sequence
  Synthetic Polynucleotide
ccaattgtggtctacttatyaag

SEQ ID NO: 3641 - DNA, 23 bp, Artificial Sequence
  Synthetic Polynucleotide
ccgtcgctccaattacttcygac

SEQ ID NO: 3642 - DNA, 23 bp, Artificial Sequence
  Synthetic Polynucleotide
ggctcrgaggcacatgaaagtgg

SEQ ID NO: 3643 - DNA, 23 bp, Artificial Sequence
  Synthetic Polynucleotide
ggagcrttgtaccagcttcctgg

SEQ ID NO: 3644 - DNA, 23 bp, Artificial Sequence
  Synthetic Polynucleotide
ctgcaccrccacatagaggaagg

SEQ ID NO: 3645 - DNA, 23 bp, Artificial Sequence
  Synthetic Polynucleotide
ccctggtattgatgtcaycacag

SEQ ID NO: 3646 - DNA, 23 bp, Artificial Sequence
  Synthetic Polynucleotide
cctggtattgatgtcaycacaga

SEQ ID NO: 3647 - DNA, 23 bp, Artificial Sequence
  Synthetic Polynucleotide
ccaagtttgagcagcacayggtc

SEQ ID NO: 3648 - DNA, 23 bp, Artificial Sequence
  Synthetic Polynucleotide
cctggtgcctctacacccyggtg

SEQ ID NO: 3649 - DNA, 23 bp, Artificial Sequence
  Synthetic Polynucleotide
cctgaatgtgatgttctctycct

SEQ ID NO: 3650 - DNA, 23 bp, Artificial Sequence
  Synthetic Polynucleotide
gtgraaacagcggatgattctgg

SEQ ID NO: 3651 - DNA, 23 bp, Artificial Sequence
  Synthetic Polynucleotide
ccgagggacccggtggcctygtc

SEQ ID NO: 3652 - DNA, 23 bp, Artificial Sequence
  Synthetic Polynucleotide
tgacacatrattctgtatggagg

SEQ ID NO: 3653 - DNA, 23 bp, Artificial Sequence
  Synthetic Polynucleotide
ccagtgcatcccctyggcaattg

SEQ ID NO: 3654 - DNA, 23 bp, Artificial Sequence
  Synthetic Polynucleotide
cctctggatatctgtyattcagc

SEQ ID NO: 3655 - DNA, 23 bp, Artificial Sequence
  Synthetic Polynucleotide
agtggctrgacagaggaagatgg

SEQ ID NO: 3656 - DNA, 23 bp, Artificial Sequence
  Synthetic Polynucleotide
gcargtacagtccaaaatctggg

SEQ ID NO: 3657 - DNA, 23 bp, Artificial Sequence
  Synthetic Polynucleotide
ggcargtacagtccaaaatctgg

SEQ ID NO: 3658 - DNA, 23 bp, Artificial Sequence
  Synthetic Polynucleotide
ccatgtgctggcaatyaagggac

SEQ ID NO: 3659 - DNA, 23 bp, Artificial Sequence
  Synthetic Polynucleotide
ccatagaaacagtgtatgyagcc

SEQ ID NO: 3660 - DNA, 23 bp, Artificial Sequence
  Synthetic Polynucleotide
cctcagtgggccttggcayagca

SEQ ID NO: 3661 - DNA, 23 bp, Artificial Sequence
  Synthetic Polynucleotide
ccccctttggagggactgcytat

SEQ ID NO: 3662 - DNA, 23 bp, Artificial Sequence
  Synthetic Polynucleotide
cccctttggagggactgcytatc

SEQ ID NO: 3663 - DNA, 23 bp, Artificial Sequence
  Synthetic Polynucleotide
ccctttggagggactgcytatct

SEQ ID NO: 3664 - DNA, 23 bp, Artificial Sequence
  Synthetic Polynucleotide
cctttggagggactgcytatctt

SEQ ID NO: 3665 - DNA, 23 bp, Artificial Sequence
  Synthetic Polynucleotide
ccagtttagatgcaaaatycaca

SEQ ID NO: 3666 - DNA, 23 bp, Artificial Sequence
  Synthetic Polynucleotide
cccctgtccagtcagcccyaggc

SEQ ID NO: 3667 - DNA, 23 bp, Artificial Sequence
  Synthetic Polynucleotide
ccctgtccagtcagcccyaggcc

SEQ ID NO: 3668 - DNA, 23 bp, Artificial Sequence
  Synthetic Polynucleotide
cctgtccagtcagcccyaggcca

SEQ ID NO: 3669 - DNA, 23 bp, Artificial Sequence
  Synthetic Polynucleotide
cctatcttcattcttygactagc

SEQ ID NO: 3670 - DNA, 23 bp, Artificial Sequence
  Synthetic Polynucleotide
cctggagcgggtgcagyagcaca

SEQ ID NO: 3671 - DNA, 23 bp, Artificial Sequence
  Synthetic Polynucleotide
ccgaaggaaagaagaggaayggc

SEQ ID NO: 3672 - DNA, 23 bp, Artificial Sequence
  Synthetic Polynucleotide
ctcttrattcccctccttcatgg

SEQ ID NO: 3673 - DNA, 23 bp, Artificial Sequence
  Synthetic Polynucleotide
ccgtctctcggcccggyggcaca

SEQ ID NO: 3674 - DNA, 23 bp, Artificial Sequence
  Synthetic Polynucleotide
catgrgggaaccaggtgagaggg

SEQ ID NO: 3675 - DNA, 23 bp, Artificial Sequence
  Synthetic Polynucleotide
ccatgrgggaaccaggtgagagg

SEQ ID NO: 3676 - DNA, 23 bp, Artificial Sequence
  Synthetic Polynucleotide
ctgrcgtgattggacttaccggg

SEQ ID NO: 3677 - DNA, 23 bp, Artificial Sequence
  Synthetic Polynucleotide
actgrcgtgattggacttaccgg

SEQ ID NO: 3678 - DNA, 23 bp, Artificial Sequence
  Synthetic Polynucleotide
cacragtttggccacgccatggg

SEQ ID NO: 3679 - DNA, 23 bp, Artificial Sequence
  Synthetic Polynucleotide
ccacragtttggccacgccatgg

SEQ ID NO: 3680 - DNA, 23 bp, Artificial Sequence
  Synthetic Polynucleotide
gcctgcraatcacagctgatggg

SEQ ID NO: 3681 - DNA, 23 bp, Artificial Sequence
  Synthetic Polynucleotide
cgcctgcraatcacagctgatgg

SEQ ID NO: 3682 - DNA, 23 bp, Artificial Sequence
  Synthetic Polynucleotide
ccggcagcacagctacctgygga

SEQ ID NO: 3683 - DNA, 23 bp, Artificial Sequence
  Synthetic Polynucleotide
ccagctcatccagggagggyggc

SEQ ID NO: 3684 - DNA, 23 bp, Artificial Sequence
  Synthetic Polynucleotide
aagcrgatctcccagcaaggtgg

SEQ ID NO: 3685 - DNA, 23 bp, Artificial Sequence
  Synthetic Polynucleotide
gtgaagcrgatctcccagcaagg

SEQ ID NO: 3686 - DNA, 23 bp, Artificial Sequence
  Synthetic Polynucleotide
cctcttcaaagtgctctyagttg

SEQ ID NO: 3687 - DNA, 23 bp, Artificial Sequence
  Synthetic Polynucleotide
cctactggctgcagctgygcagc

SEQ ID NO: 3688 - DNA, 23 bp, Artificial Sequence
  Synthetic Polynucleotide
ccgcaaccagatcaacgygctca

SEQ ID NO: 3689 - DNA, 23 bp, Artificial Sequence
  Synthetic Polynucleotide
gagaggccrgactctgaccatgg

SEQ ID NO: 3690 - DNA, 23 bp, Artificial Sequence
  Synthetic Polynucleotide
caactrggccaaactacagcggg

SEQ ID NO: 3691 - DNA, 23 bp, Artificial Sequence
  Synthetic Polynucleotide
acaactrggccaaactacagcgg

SEQ ID NO: 3692 - DNA, 23 bp, Artificial Sequence
  Synthetic Polynucleotide
gctrgtacaaggttttggatcgg

SEQ ID NO: 3693 - DNA, 23 bp, Artificial Sequence
  Synthetic Polynucleotide
aggaggctrgtacaaggttttgg

SEQ ID NO: 3694 - DNA, 23 bp, Artificial Sequence
  Synthetic Polynucleotide
ccctaggggggctttgcccygtg

SEQ ID NO: 3695 - DNA, 23 bp, Artificial Sequence
  Synthetic Polynucleotide
cctaggggggctttgcccygtgt

SEQ ID NO: 3696 - DNA, 23 bp, Artificial Sequence
  Synthetic Polynucleotide
catagtgrgcaagacctctcagg

SEQ ID NO: 3697 - DNA, 23 bp, Artificial Sequence
  Synthetic Polynucleotide
ggtagrggaccctcgctggaagg

SEQ ID NO: 3698 - DNA, 23 bp, Artificial Sequence
  Synthetic Polynucleotide
ccatggtgctgtgggctyccggg

SEQ ID NO: 3699 - DNA, 23 bp, Artificial Sequence
  Synthetic Polynucleotide
ccaacaaaggaagaggcygagga

SEQ ID NO: 3700 - DNA, 23 bp, Artificial Sequence
  Synthetic Polynucleotide
gtgrattaagcagcctctcatgg

SEQ ID NO: 3701 - DNA, 23 bp, Artificial Sequence
  Synthetic Polynucleotide
cgacatgrcggtgcagccgaagg

SEQ ID NO: 3702 - DNA, 23 bp, Artificial Sequence
  Synthetic Polynucleotide
acaggttrgagttgggtatgtgg

SEQ ID NO: 3703 - DNA, 23 bp, Artificial Sequence
  Synthetic Polynucleotide
ccttaactatgctttatyaggtg

SEQ ID NO: 3704 - DNA, 23 bp, Artificial Sequence
  Synthetic Polynucleotide
ccattttggagaaaggayaagga

SEQ ID NO: 3705 - DNA, 23 bp, Artificial Sequence
  Synthetic Polynucleotide
ccgacttgccaagaagtttyaaa

SEQ ID NO: 3706 - DNA, 23 bp, Artificial Sequence
  Synthetic Polynucleotide
ccacaaaagacatttatyaggac

SEQ ID NO: 3707 - DNA, 23 bp, Artificial Sequence
  Synthetic Polynucleotide
ccgggaggtgttcaagaccyagg

SEQ ID NO: 3708 - DNA, 23 bp, Artificial Sequence
  Synthetic Polynucleotide
ccgcagttgatggcyagagacag

SEQ ID NO: 3709 - DNA, 23 bp, Artificial Sequence
  Synthetic Polynucleotide
cctgttccatatgtacgacyagc

SEQ ID NO: 3710 - DNA, 23 bp, Artificial Sequence
  Synthetic Polynucleotide
ccctgtcaaagttgctygaaagc

SEQ ID NO: 3711 - DNA, 23 bp, Artificial Sequence
  Synthetic Polynucleotide
cctgtcaaagttgctygaaagcg

SEQ ID NO: 3712 - DNA, 23 bp, Artificial Sequence
  Synthetic Polynucleotide
ccaagaagggctgtaaaygatac

SEQ ID NO: 3713 - DNA, 23 bp, Artificial Sequence
  Synthetic Polynucleotide
ccagaaatgatggaggcaygatg

SEQ ID NO: 3714 - DNA, 23 bp, Artificial Sequence
  Synthetic Polynucleotide
cccaccctggagcctycgtagac

SEQ ID NO: 3715 - DNA, 23 bp, Artificial Sequence
  Synthetic Polynucleotide
ccaccctggagcctycgtagacc

SEQ ID NO: 3716 - DNA, 23 bp, Artificial Sequence
  Synthetic Polynucleotide
tttgtarccacaggcttccacgg

SEQ ID NO: 3717 - DNA, 23 bp, Artificial Sequence
  Synthetic Polynucleotide
tccaaaaargccttcgatacggg

SEQ ID NO: 3718 - DNA, 23 bp, Artificial Sequence
  Synthetic Polynucleotide
atccrctaccttcacgccaatgg

SEQ ID NO: 3719 - DNA, 23 bp, Artificial Sequence
  Synthetic Polynucleotide
atctccrcatgatgaaacttcgg

SEQ ID NO: 3720 - DNA, 23 bp, Artificial Sequence
  Synthetic Polynucleotide
cttaccraacgaaaaattctagg

SEQ ID NO: 3721 - DNA, 23 bp, Artificial Sequence
  Synthetic Polynucleotide
aaccrgctttttgcccaaatggg

SEQ ID NO: 3722 - DNA, 23 bp, Artificial Sequence
  Synthetic Polynucleotide
taaccrgctttttgcccaaatgg

SEQ ID NO: 3723 - DNA, 23 bp, Artificial Sequence
  Synthetic Polynucleotide
taarcccttactagaccaatggg

SEQ ID NO: 3724 - DNA, 23 bp, Artificial Sequence
  Synthetic Polynucleotide
ctaarcccttactagaccaatgg

SEQ ID NO: 3725 - DNA, 23 bp, Artificial Sequence
  Synthetic Polynucleotide
tacactraaaatgtttagacggg

SEQ ID NO: 3726 - DNA, 23 bp, Artificial Sequence
  Synthetic Polynucleotide
atacactraaaatgtttagacgg

SEQ ID NO: 3727 - DNA, 23 bp, Artificial Sequence
  Synthetic Polynucleotide
agctaarcaccctaatcaactgg

SEQ ID NO: 3728 - DNA, 23 bp, Artificial Sequence
  Synthetic Polynucleotide
ccagcaaggactgaaytgttaac

SEQ ID NO: 3729 - DNA, 23 bp, Artificial Sequence
  Synthetic Polynucleotide
tcacttgrggcatcttccctggg

SEQ ID NO: 3730 - DNA, 23 bp, Artificial Sequence
  Synthetic Polynucleotide
gtcacttgrggcatcttccctgg

SEQ ID NO: 3731 - DNA, 23 bp, Artificial Sequence
  Synthetic Polynucleotide
agatgtacrtcccatcttctggg

SEQ ID NO: 3732 - DNA, 23 bp, Artificial Sequence
  Synthetic Polynucleotide
cttcatrttctggaaggtaaagg

SEQ ID NO: 3733 - DNA, 23 bp, Artificial Sequence
  Synthetic Polynucleotide
tcatgtrcaggatggtctccagg

SEQ ID NO: 3734 - DNA, 23 bp, Artificial Sequence
  Synthetic Polynucleotide
ccccctacaggtttgacyggatg

SEQ ID NO: 3735 - DNA, 23 bp, Artificial Sequence
  Synthetic Polynucleotide
cccctacaggtttgacyggatgg

SEQ ID NO: 3736 - DNA, 23 bp, Artificial Sequence
  Synthetic Polynucleotide
ccctacaggtttgacyggatggc

SEQ ID NO: 3737 - DNA, 23 bp, Artificial Sequence
  Synthetic Polynucleotide
cctacaggtttgacyggatggca

SEQ ID NO: 3738 - DNA, 23 bp, Artificial Sequence
  Synthetic Polynucleotide
cccaggcgtcccctaycctgggc

SEQ ID NO: 3739 - DNA, 23 bp, Artificial Sequence
  Synthetic Polynucleotide
ccaggcgtcccctaycctgggct

SEQ ID NO: 3740 - DNA, 23 bp, Artificial Sequence
  Synthetic Polynucleotide
ccctgggctctcagcgccyaccc

SEQ ID NO: 3741 - DNA, 23 bp, Artificial Sequence
  Synthetic Polynucleotide
cctgggctctcagcgccyacccc

SEQ ID NO: 3742 - DNA, 23 bp, Artificial Sequence
  Synthetic Polynucleotide
ccggtttggttctccygagaggt

SEQ ID NO: 3743 - DNA, 23 bp, Artificial Sequence
  Synthetic Polynucleotide
cctacacacacataccccygcac

SEQ ID NO: 3744 - DNA, 23 bp, Artificial Sequence
  Synthetic Polynucleotide
ccgcctcatcttctccyggagtc

SEQ ID NO: 3745 - DNA, 23 bp, Artificial Sequence
  Synthetic Polynucleotide
cctggtgaagcacatcygaagtg

SEQ ID NO: 3746 - DNA, 23 bp, Artificial Sequence
  Synthetic Polynucleotide
ccaaagagttacatctacygtac

SEQ ID NO: 3747 - DNA, 23 bp, Artificial Sequence
  Synthetic Polynucleotide
gaaraaaagtttaacgtggatgg

SEQ ID NO: 3748 - DNA, 23 bp, Artificial Sequence
  Synthetic Polynucleotide
aaatgaaraaaagtttaacgtgg

SEQ ID NO: 3749 - DNA, 23 bp, Artificial Sequence
  Synthetic Polynucleotide
tgtgtrgcaaatgtcaaaacagg

SEQ ID NO: 3750 - DNA, 23 bp, Artificial Sequence
  Synthetic Polynucleotide
aaaacagrtaaggaatatgaggg

SEQ ID NO: 3751 - DNA, 23 bp, Artificial Sequence
  Synthetic Polynucleotide
caaaacagrtaaggaatatgagg

SEQ ID NO: 3752 - DNA, 23 bp, Artificial Sequence
  Synthetic Polynucleotide
tgtttctaracgtctcgagatgg

SEQ ID NO: 3753 - DNA, 23 bp, Artificial Sequence
  Synthetic Polynucleotide
cctcacagggcttgyccaatcac

SEQ ID NO: 3754 - DNA, 23 bp, Artificial Sequence
  Synthetic Polynucleotide
ccattggagaataayttttatta

SEQ ID NO: 3755 - DNA, 23 bp, Artificial Sequence
  Synthetic Polynucleotide
cctgctcttttggtggttcygta

SEQ ID NO: 3756 - DNA, 23 bp, Artificial Sequence
  Synthetic Polynucleotide
cctcagatgatgacytccggaga

SEQ ID NO: 3757 - DNA, 23 bp, Artificial Sequence
  Synthetic Polynucleotide
ggaagrgagtatgtacaggctgg

SEQ ID NO: 3758 - DNA, 23 bp, Artificial Sequence
  Synthetic Polynucleotide
cctcattacctgaggyaggtaaa

SEQ ID NO: 3759 - DNA, 23 bp, Artificial Sequence
  Synthetic Polynucleotide
ccaggctcatacagcaaygactt

SEQ ID NO: 3760 - DNA, 23 bp, Artificial Sequence
  Synthetic Polynucleotide
cagrtctgctggcaggactgtgg

SEQ ID NO: 3761 - DNA, 23 bp, Artificial Sequence
  Synthetic Polynucleotide
aactcagrtacctggatactggg

SEQ ID NO: 3762 - DNA, 23 bp, Artificial Sequence
  Synthetic Polynucleotide
caactcagrtacctggatactgg

SEQ ID NO: 3763 - DNA, 23 bp, Artificial Sequence
  Synthetic Polynucleotide
cccgtttctcttggtcgtaycag

SEQ ID NO: 3764 - DNA, 23 bp, Artificial Sequence
  Synthetic Polynucleotide
ccgtttctcttggtcgtaycagc

SEQ ID NO: 3765 - DNA, 23 bp, Artificial Sequence
  Synthetic Polynucleotide
ccaatggctcggacayggcacag

SEQ ID NO: 3766 - DNA, 23 bp, Artificial Sequence
  Synthetic Polynucleotide
cccagctcccaacactggayagt

SEQ ID NO: 3767 - DNA, 23 bp, Artificial Sequence
  Synthetic Polynucleotide
ccagctcccaacactggayagtg

SEQ ID NO: 3768 - DNA, 23 bp, Artificial Sequence
  Synthetic Polynucleotide
cctctcaggtggagyaggaacag

SEQ ID NO: 3769 - DNA, 23 bp, Artificial Sequence
  Synthetic Polynucleotide
cctctgagacccacaytggggga

SEQ ID NO: 3770 - DNA, 23 bp, Artificial Sequence
  Synthetic Polynucleotide
cccaaattctgctggtgyagagg

SEQ ID NO: 3771 - DNA, 23 bp, Artificial Sequence
  Synthetic Polynucleotide
ccaaattctgctggtgyagaggc

SEQ ID NO: 3772 - DNA, 23 bp, Artificial Sequence
  Synthetic Polynucleotide
ggcrcaggcggtggtggctgtgg

SEQ ID NO: 3773 - DNA, 23 bp, Artificial Sequence
  Synthetic Polynucleotide
cggcrtgggccacgcctctctgg

SEQ ID NO: 3774 - DNA, 23 bp, Artificial Sequence
  Synthetic Polynucleotide
ccacggaggttgagccgggyaca

SEQ ID NO: 3775 - DNA, 23 bp, Artificial Sequence
  Synthetic Polynucleotide
gtcatcrgtgaggccggccgggg

SEQ ID NO: 3776 - DNA, 23 bp, Artificial Sequence
  Synthetic Polynucleotide
ggtcatcrgtgaggccggccggg

SEQ ID NO: 3777 - DNA, 23 bp, Artificial Sequence
  Synthetic Polynucleotide
aggtcatcrgtgaggccggccgg

SEQ ID NO: 3778 - DNA, 23 bp, Artificial Sequence
  Synthetic Polynucleotide
tgagcrgcaggtgcagcctgggg

SEQ ID NO: 3779 - DNA, 23 bp, Artificial Sequence
  Synthetic Polynucleotide
atgagcrgcaggtgcagcctggg

SEQ ID NO: 3780 - DNA, 23 bp, Artificial Sequence
  Synthetic Polynucleotide
gatgagcrgcaggtgcagcctgg

SEQ ID NO: 3781 - DNA, 23 bp, Artificial Sequence
  Synthetic Polynucleotide
ttcctrgttcaagaatggcctgg

SEQ ID NO: 3782 - DNA, 23 bp, Artificial Sequence
  Synthetic Polynucleotide
ggctargctgaaggacggggtgg

SEQ ID NO: 3783 - DNA, 23 bp, Artificial Sequence
  Synthetic Polynucleotide
cccggctargctgaaggacgggg

SEQ ID NO: 3784 - DNA, 23 bp, Artificial Sequence
  Synthetic Polynucleotide
tcatggrtgagcctgctccaggg

SEQ ID NO: 3785 - DNA, 23 bp, Artificial Sequence
  Synthetic Polynucleotide
ttcatggrtgagcctgctccagg

SEQ ID NO: 3786 - DNA, 23 bp, Artificial Sequence
  Synthetic Polynucleotide
gtgrcggcccccagagcgcgtgg

SEQ ID NO: 3787 - DNA, 23 bp, Artificial Sequence
  Synthetic Polynucleotide
tgacgcctrgggtcttaatgtgg

SEQ ID NO: 3788 - DNA, 23 bp, Artificial Sequence
  Synthetic Polynucleotide
gccccaagrtagggaactttagg

SEQ ID NO: 3789 - DNA, 23 bp, Artificial Sequence
  Synthetic Polynucleotide
gagtrccgcctggaggtgcgagg

SEQ ID NO: 3790 - DNA, 23 bp, Artificial Sequence
  Synthetic Polynucleotide
tctgcartgcctcagtgaccagg

SEQ ID NO: 3791 - DNA, 23 bp, Artificial Sequence
  Synthetic Polynucleotide
tgtccacrgtgagggggccctgg

SEQ ID NO: 3792 - DNA, 23 bp, Artificial Sequence
  Synthetic Polynucleotide
gggtggcragaagtgtagcacgg

SEQ ID NO: 3793 - DNA, 23 bp, Artificial Sequence
  Synthetic Polynucleotide
tgcaggrccaccaacttacaggg

SEQ ID NO: 3794 - DNA, 23 bp, Artificial Sequence
  Synthetic Polynucleotide
ctgcaggrccaccaacttacagg

SEQ ID NO: 3795 - DNA, 23 bp, Artificial Sequence
  Synthetic Polynucleotide
gggcrgtgagtgtgcagggcagg

SEQ ID NO: 3796 - DNA, 23 bp, Artificial Sequence
  Synthetic Polynucleotide
catcgggcrgtgagtgtgcaggg

SEQ ID NO: 3797 - DNA, 23 bp, Artificial Sequence
  Synthetic Polynucleotide
aaagrtgggcctgggacctgagg

SEQ ID NO: 3798 - DNA, 23 bp, Artificial Sequence
  Synthetic Polynucleotide
cgtgtgrgagatcctacggcagg

SEQ ID NO: 3799 - DNA, 23 bp, Artificial Sequence
  Synthetic Polynucleotide
ccaggagtrgttcaccgtcttgg

SEQ ID NO: 3800 - DNA, 23 bp, Artificial Sequence
  Synthetic Polynucleotide
ccargagtggttcaccgtcttgg

SEQ ID NO: 3801 - DNA, 23 bp, Artificial Sequence
  Synthetic Polynucleotide
ccarctgctgtgtgagaccgagg

SEQ ID NO: 3802 - DNA, 23 bp, Artificial Sequence
  Synthetic Polynucleotide
agtrggtggctgccctgcagggg

SEQ ID NO: 3803 - DNA, 23 bp, Artificial Sequence
  Synthetic Polynucleotide
gagtrggtggctgccctgcaggg

SEQ ID NO: 3804 - DNA, 23 bp, Artificial Sequence
  Synthetic Polynucleotide
agagtrggtggctgccctgcagg

SEQ ID NO: 3805 - DNA, 23 bp, Artificial Sequence
  Synthetic Polynucleotide
aatrgtgagttccagaagcacgg

SEQ ID NO: 3806 - DNA, 23 bp, Artificial Sequence
  Synthetic Polynucleotide
tgtgtgrctgaagaatgggaagg

SEQ ID NO: 3807 - DNA, 23 bp, Artificial Sequence
  Synthetic Polynucleotide
agtgrgtggctgccctgcagggg

SEQ ID NO: 3808 - DNA, 23 bp, Artificial Sequence
  Synthetic Polynucleotide
gagtgrgtggctgccctgcaggg

SEQ ID NO: 3809 - DNA, 23 bp, Artificial Sequence
  Synthetic Polynucleotide
agagtgrgtggctgccctgcagg

SEQ ID NO: 3810 - DNA, 23 bp, Artificial Sequence
  Synthetic Polynucleotide
tcarggcaagccccggcctcagg

SEQ ID NO: 3811 - DNA, 23 bp, Artificial Sequence
  Synthetic Polynucleotide
ggcagrtgcagcctggggtgggg

SEQ ID NO: 3812 - DNA, 23 bp, Artificial Sequence
  Synthetic Polynucleotide
cggcagrtgcagcctggggtggg

SEQ ID NO: 3813 - DNA, 23 bp, Artificial Sequence
  Synthetic Polynucleotide
gcggcagrtgcagcctggggtgg

SEQ ID NO: 3814 - DNA, 23 bp, Artificial Sequence
  Synthetic Polynucleotide
cagggtgarcctggctggggggg

SEQ ID NO: 3815 - DNA, 23 bp, Artificial Sequence
  Synthetic Polynucleotide
accrgctccgtggtggtaacagg

SEQ ID NO: 3816 - DNA, 23 bp, Artificial Sequence
  Synthetic Polynucleotide
ccctgaccatcagcyagtgctca

SEQ ID NO: 3817 - DNA, 23 bp, Artificial Sequence
  Synthetic Polynucleotide
ccacgctggtgctgyaggttgtt

SEQ ID NO: 3818 - DNA, 23 bp, Artificial Sequence
  Synthetic Polynucleotide
ccgcatgttcagcaagyagggag

SEQ ID NO: 3819 - DNA, 23 bp, Artificial Sequence
  Synthetic Polynucleotide
cctgagcagcaaggtgggcyagc

SEQ ID NO: 3820 - DNA, 23 bp, Artificial Sequence
  Synthetic Polynucleotide
ccctcgatcatgcgccgcgyttc

SEQ ID NO: 3821 - DNA, 23 bp, Artificial Sequence
  Synthetic Polynucleotide
cctcgatcatgcgccgcgyttca

SEQ ID NO: 3822 - DNA, 23 bp, Artificial Sequence
  Synthetic Polynucleotide
cccgggtcagctccacccygtcc

SEQ ID NO: 3823 - DNA, 23 bp, Artificial Sequence
  Synthetic Polynucleotide
ccgggtcagctccacccygtcct

SEQ ID NO: 3824 - DNA, 23 bp, Artificial Sequence
  Synthetic Polynucleotide
ccagcctcctgaagcygcctgtg

SEQ ID NO: 3825 - DNA, 23 bp, Artificial Sequence
  Synthetic Polynucleotide
cctggctggaggtggtcggygga

SEQ ID NO: 3826 - DNA, 23 bp, Artificial Sequence
  Synthetic Polynucleotide
ccggttcaagaaggacgggyaga

SEQ ID NO: 3827 - DNA, 23 bp, Artificial Sequence
  Synthetic Polynucleotide
ccattgacgacgtcacayctgcc

SEQ ID NO: 3828 - DNA, 23 bp, Artificial Sequence
  Synthetic Polynucleotide
cctggaccaaagaggggyagccc

SEQ ID NO: 3829 - DNA, 23 bp, Artificial Sequence
  Synthetic Polynucleotide
cctcttcgtgatgcggccayagg

SEQ ID NO: 3830 - DNA, 23 bp, Artificial Sequence
  Synthetic Polynucleotide
ccccaagcttcaccyagcccctg

SEQ ID NO: 3831 - DNA, 23 bp, Artificial Sequence
  Synthetic Polynucleotide
ccaggccattcttgaaycaggaa

SEQ ID NO: 3832 - DNA, 23 bp, Artificial Sequence
  Synthetic Polynucleotide
ccgcaggtgcgtctggcaygtct

SEQ ID NO: 3833 - DNA, 23 bp, Artificial Sequence
  Synthetic Polynucleotide
cccggctgcttttcygagtgcgg

SEQ ID NO: 3834 - DNA, 23 bp, Artificial Sequence
  Synthetic Polynucleotide
gccagcrccgcaacgaccttcgg

SEQ ID NO: 3835 - DNA, 23 bp, Artificial Sequence
  Synthetic Polynucleotide
gccrgcagggcttccccaaccgg

SEQ ID NO: 3836 - DNA, 23 bp, Artificial Sequence
  Synthetic Polynucleotide
ccaggagctagaggcccacyttg

SEQ ID NO: 3837 - DNA, 23 bp, Artificial Sequence
  Synthetic Polynucleotide
cctgcctcaacgaggcctyggtc

SEQ ID NO: 3838 - DNA, 23 bp, Artificial Sequence
  Synthetic Polynucleotide
cctcaacgaggcctyggtcctgc

SEQ ID NO: 3839 - DNA, 23 bp, Artificial Sequence
  Synthetic Polynucleotide
ttgggaacrccaagactgtgagg

SEQ ID NO: 3840 - DNA, 23 bp, Artificial Sequence
  Synthetic Polynucleotide
ccagtccattctgatcaygtaag

SEQ ID NO: 3841 - DNA, 23 bp, Artificial Sequence
  Synthetic Polynucleotide
ggctcgccrcaaggagctggagg

SEQ ID NO: 3842 - DNA, 23 bp, Artificial Sequence
  Synthetic Polynucleotide
cctgctgcrgctgcaggacctgg

SEQ ID NO: 3843 - DNA, 23 bp, Artificial Sequence
  Synthetic Polynucleotide
tcctccrtctgggggccagaggg

SEQ ID NO: 3844 - DNA, 23 bp, Artificial Sequence
  Synthetic Polynucleotide
ctcctccrtctgggggccagagg

SEQ ID NO: 3845 - DNA, 23 bp, Artificial Sequence
  Synthetic Polynucleotide
attcattcraattcattttgggg

SEQ ID NO: 3846 - DNA, 23 bp, Artificial Sequence
  Synthetic Polynucleotide
acaggcrccatcatgcactttgg

SEQ ID NO: 3847 - DNA, 23 bp, Artificial Sequence
  Synthetic Polynucleotide
tgccactrgggcactggccaagg

SEQ ID NO: 3848 - DNA, 23 bp, Artificial Sequence
  Synthetic Polynucleotide
cagccacrccagtacttcatagg

SEQ ID NO: 3849 - DNA, 23 bp, Artificial Sequence
  Synthetic Polynucleotide
gtatcrcatcctgaacccagcgg

SEQ ID NO: 3850 - DNA, 23 bp, Artificial Sequence
  Synthetic Polynucleotide
ggacrccattcagcggactgagg

SEQ ID NO: 3851 - DNA, 23 bp, Artificial Sequence
  Synthetic Polynucleotide
agagragctgaagaaggagcagg

SEQ ID NO: 3852 - DNA, 23 bp, Artificial Sequence
  Synthetic Polynucleotide
gccragcagatcgccctcaaggg

SEQ ID NO: 3853 - DNA, 23 bp, Artificial Sequence
  Synthetic Polynucleotide
agccragcagatcgccctcaagg

SEQ ID NO: 3854 - DNA, 23 bp, Artificial Sequence
  Synthetic Polynucleotide
gacgcrcatcaatgccaccctgg

SEQ ID NO: 3855 - DNA, 23 bp, Artificial Sequence
  Synthetic Polynucleotide
gaacragaggctggaggatgagg

SEQ ID NO: 3856 - DNA, 23 bp, Artificial Sequence
  Synthetic Polynucleotide
tctacrgggacttccggcagagg

SEQ ID NO: 3857 - DNA, 23 bp, Artificial Sequence
  Synthetic Polynucleotide
tccrgcagaggtgggtatgaggg

SEQ ID NO: 3858 - DNA, 23 bp, Artificial Sequence
  Synthetic Polynucleotide
ttccrgcagaggtgggtatgagg

SEQ ID NO: 3859 - DNA, 23 bp, Artificial Sequence
  Synthetic Polynucleotide
ccagrccaaccctgctctggagg

SEQ ID NO: 3860 - DNA, 23 bp, Artificial Sequence
  Synthetic Polynucleotide
catccagrccaaccctgctctgg

SEQ ID NO: 3861 - DNA, 23 bp, Artificial Sequence
  Synthetic Polynucleotide
acgcatcraggagctggaggagg

SEQ ID NO: 3862 - DNA, 23 bp, Artificial Sequence
  Synthetic Polynucleotide
acagcrgagaatccggagcaggg

SEQ ID NO: 3863 - DNA, 23 bp, Artificial Sequence
  Synthetic Polynucleotide
cacagcrgagaatccggagcagg

SEQ ID NO: 3864 - DNA, 23 bp, Artificial Sequence
  Synthetic Polynucleotide
gatgrcagaggagctgaagaagg

SEQ ID NO: 3865 - DNA, 23 bp, Artificial Sequence
  Synthetic Polynucleotide
tgctraggagaaggccaagaagg

SEQ ID NO: 3866 - DNA, 23 bp, Artificial Sequence
  Synthetic Polynucleotide
cctggagcgagcgaagyggaagc

SEQ ID NO: 3867 - DNA, 23 bp, Artificial Sequence
  Synthetic Polynucleotide
cctctacggggacttcyggcaga

SEQ ID NO: 3868 - DNA, 23 bp, Artificial Sequence
  Synthetic Polynucleotide
cctggcagatgctgaggagygct

SEQ ID NO: 3869 - DNA, 23 bp, Artificial Sequence
  Synthetic Polynucleotide
cccatccccactttgtaygttgt

SEQ ID NO: 3870 - DNA, 23 bp, Artificial Sequence
  Synthetic Polynucleotide
ccatccccactttgtaygttgta

SEQ ID NO: 3871 - DNA, 23 bp, Artificial Sequence
  Synthetic Polynucleotide
cctggtcatgcaccagctgygct

SEQ ID NO: 3872 - DNA, 23 bp, Artificial Sequence
  Synthetic Polynucleotide
ccaaagaggcaccttctygatga

SEQ ID NO: 3873 - DNA, 23 bp, Artificial Sequence
  Synthetic Polynucleotide
ccggctggacgaagycgagcaga

SEQ ID NO: 3874 - DNA, 23 bp, Artificial Sequence
  Synthetic Polynucleotide
ccgtgacattggcaygaaggtgg

SEQ ID NO: 3875 - DNA, 23 bp, Artificial Sequence
  Synthetic Polynucleotide
cctccagctccttgcggygagcc

SEQ ID NO: 3876 - DNA, 23 bp, Artificial Sequence
  Synthetic Polynucleotide
ccagctccttgcggygagcctcg

SEQ ID NO: 3877 - DNA, 23 bp, Artificial Sequence
  Synthetic Polynucleotide
gccrccagggcttccccaacagg

SEQ ID NO: 3878 - DNA, 23 bp, Artificial Sequence
  Synthetic Polynucleotide
ggcatccrtatctgccgccaggg

SEQ ID NO: 3879 - DNA, 23 bp, Artificial Sequence
  Synthetic Polynucleotide
gggcatccrtatctgccgccagg

SEQ ID NO: 3880 - DNA, 23 bp, Artificial Sequence
  Synthetic Polynucleotide
tcggaccragaagaagctgaagg

SEQ ID NO: 3881 - DNA, 23 bp, Artificial Sequence
  Synthetic Polynucleotide
cctcaacgaagcctyggtgctgc

SEQ ID NO: 3882 - DNA, 23 bp, Artificial Sequence
  Synthetic Polynucleotide
ccgtttgtcgtgccccgcygaat

SEQ ID NO: 3883 - DNA, 23 bp, Artificial Sequence
  Synthetic Polynucleotide
ccacgragaagagaaggactagg

SEQ ID NO: 3884 - DNA, 23 bp, Artificial Sequence
  Synthetic Polynucleotide
ccacrgagaagagaaggactagg

SEQ ID NO: 3885 - DNA, 23 bp, Artificial Sequence
  Synthetic Polynucleotide
atcgacagrtatcttggttacgg

SEQ ID NO: 3886 - DNA, 23 bp, Artificial Sequence
  Synthetic Polynucleotide
cagrtgggtcagcaccaggcggg

SEQ ID NO: 3887 - DNA, 23 bp, Artificial Sequence
  Synthetic Polynucleotide
gcagrtgggtcagcaccaggcgg

SEQ ID NO: 3888 - DNA, 23 bp, Artificial Sequence
  Synthetic Polynucleotide
gtggcagrtgggtcagcaccagg

SEQ ID NO: 3889 - DNA, 23 bp, Artificial Sequence
  Synthetic Polynucleotide
ccagrtgaggggggaaggtgggg

SEQ ID NO: 3890 - DNA, 23 bp, Artificial Sequence
  Synthetic Polynucleotide
cccagrtgaggggggaaggtggg

SEQ ID NO: 3891 - DNA, 23 bp, Artificial Sequence
  Synthetic Polynucleotide
acccagrtgaggggggaaggtgg

SEQ ID NO: 3892 - DNA, 23 bp, Artificial Sequence
  Synthetic Polynucleotide
ctgrctgtgtcatcgcaagctgg

SEQ ID NO: 3893 - DNA, 23 bp, Artificial Sequence
  Synthetic Polynucleotide
ccgctgcatcaagcycaacgatg

SEQ ID NO: 3894 - DNA, 23 bp, Artificial Sequence
  Synthetic Polynucleotide
tcgccatrgtaagccgggtgcgg

SEQ ID NO: 3895 - DNA, 23 bp, Artificial Sequence
  Synthetic Polynucleotide
aaagrtgggctggagggaagggg

SEQ ID NO: 3896 - DNA, 23 bp, Artificial Sequence
  Synthetic Polynucleotide
taaagrtgggctggagggaaggg

SEQ ID NO: 3897 - DNA, 23 bp, Artificial Sequence
  Synthetic Polynucleotide
gtaaagrtgggctggagggaagg

SEQ ID NO: 3898 - DNA, 23 bp, Artificial Sequence
  Synthetic Polynucleotide
cacrgacacagccgcccagctgg

SEQ ID NO: 3899 - DNA, 23 bp, Artificial Sequence
  Synthetic Polynucleotide
cgtgcrcgacgccttcgtaaagg

SEQ ID NO: 3900 - DNA, 23 bp, Artificial Sequence
  Synthetic Polynucleotide
ccgcaatgacaactcaagcygtt

SEQ ID NO: 3901 - DNA, 23 bp, Artificial Sequence
  Synthetic Polynucleotide
ccctcactcacctacyaggtgtt

SEQ ID NO: 3902 - DNA, 23 bp, Artificial Sequence
  Synthetic Polynucleotide
cctcactcacctacyaggtgttc

SEQ ID NO: 3903 - DNA, 23 bp, Artificial Sequence
  Synthetic Polynucleotide
ccggcacctgtgcgtgcgcyagc

SEQ ID NO: 3904 - DNA, 23 bp, Artificial Sequence
  Synthetic Polynucleotide
ccatcgactgcctgcaayggctc

SEQ ID NO: 3905 - DNA, 23 bp, Artificial Sequence
  Synthetic Polynucleotide
ccagcccttctttgtgygatgca

SEQ ID NO: 3906 - DNA, 23 bp, Artificial Sequence
  Synthetic Polynucleotide
ccggctcttgcagctgygaacgg

SEQ ID NO: 3907 - DNA, 23 bp, Artificial Sequence
  Synthetic Polynucleotide
cccggaagtaccctcygcacctg

SEQ ID NO: 3908 - DNA, 23 bp, Artificial Sequence
  Synthetic Polynucleotide
ccggaagtaccctcygcacctgg

SEQ ID NO: 3909 - DNA, 23 bp, Artificial Sequence
  Synthetic Polynucleotide
aggatrtggagaactagtttggg

SEQ ID NO: 3910 - DNA, 23 bp, Artificial Sequence
  Synthetic Polynucleotide
caggatrtggagaactagtttgg

SEQ ID NO: 3911 - DNA, 23 bp, Artificial Sequence
  Synthetic Polynucleotide
ccacggacagttccygtattctt

SEQ ID NO: 3912 - DNA, 23 bp, Artificial Sequence
  Synthetic Polynucleotide
ccagaccaaacagtcttycatta

SEQ ID NO: 3913 - DNA, 23 bp, Artificial Sequence
  Synthetic Polynucleotide
tgaggggcrcctctgtcggctgg

SEQ ID NO: 3914 - DNA, 23 bp, Artificial Sequence
  Synthetic Polynucleotide
tgtcrttttgctgttgaaaaagg

SEQ ID NO: 3915 - DNA, 23 bp, Artificial Sequence
  Synthetic Polynucleotide
ctctcatcraagtgtacatgcgg

SEQ ID NO: 3916 - DNA, 23 bp, Artificial Sequence
  Synthetic Polynucleotide
catgcrgcctctgtccaacaagg

SEQ ID NO: 3917 - DNA, 23 bp, Artificial Sequence
  Synthetic Polynucleotide
ccctcrctggcggcttttcctgg

SEQ ID NO: 3918 - DNA, 23 bp, Artificial Sequence
  Synthetic Polynucleotide
gccrctaccagctgaccttgtgg

SEQ ID NO: 3919 - DNA, 23 bp, Artificial Sequence
  Synthetic Polynucleotide
actggcctrgagcggccaggagg

SEQ ID NO: 3920 - DNA, 23 bp, Artificial Sequence
  Synthetic Polynucleotide
cccgctggtcaggcggcygtccc

SEQ ID NO: 3921 - DNA, 23 bp, Artificial Sequence
  Synthetic Polynucleotide
ccgctggtcaggcggcygtccct

SEQ ID NO: 3922 - DNA, 23 bp, Artificial Sequence
  Synthetic Polynucleotide
ccagctttgccgcccggyggtat

SEQ ID NO: 3923 - DNA, 23 bp, Artificial Sequence
  Synthetic Polynucleotide
cctgctggacctcactyggcagg

SEQ ID NO: 3924 - DNA, 23 bp, Artificial Sequence
  Synthetic Polynucleotide
ccgggtcctggaccagatgygct

SEQ ID NO: 3925 - DNA, 23 bp, Artificial Sequence
  Synthetic Polynucleotide
ccattttatagatcytcctgagt

SEQ ID NO: 3926 - DNA, 23 bp, Artificial Sequence
  Synthetic Polynucleotide
gccttgtrtcttccgtttgacgg

SEQ ID NO: 3927 - DNA, 23 bp, Artificial Sequence
  Synthetic Polynucleotide
cctgctgcccctgctggagygag

SEQ ID NO: 3928 - DNA, 23 bp, Artificial Sequence
  Synthetic Polynucleotide
agagtrgctaaggcaggaaatgg

SEQ ID NO: 3929 - DNA, 23 bp, Artificial Sequence
  Synthetic Polynucleotide
ccttrtgaaaggcttggtcctgg

SEQ ID NO: 3930 - DNA, 23 bp, Artificial Sequence
  Synthetic Polynucleotide
ccgccgagaaccgcyagggcaca

SEQ ID NO: 3931 - DNA, 23 bp, Artificial Sequence
  Synthetic Polynucleotide
gttccctcraagctgaatcaagg

SEQ ID NO: 3932 - DNA, 23 bp, Artificial Sequence
  Synthetic Polynucleotide
gagrtaaggagaacagggcctgg

SEQ ID NO: 3933 - DNA, 23 bp, Artificial Sequence
  Synthetic Polynucleotide
cctgtgagrtaaggagaacaggg

SEQ ID NO: 3934 - DNA, 23 bp, Artificial Sequence
  Synthetic Polynucleotide
ccargcctggacgactccaccgg

SEQ ID NO: 3935 - DNA, 23 bp, Artificial Sequence
  Synthetic Polynucleotide
ccggccccagacttycaagctga

SEQ ID NO: 3936 - DNA, 23 bp, Artificial Sequence
  Synthetic Polynucleotide
ccacctaccggtacatcytctcc

SEQ ID NO: 3937 - DNA, 23 bp, Artificial Sequence
  Synthetic Polynucleotide
cctaccggtacatcytctcctgt

SEQ ID NO: 3938 - DNA, 23 bp, Artificial Sequence
  Synthetic Polynucleotide
cctacatcctaactygatttgct

SEQ ID NO: 3939 - DNA, 23 bp, Artificial Sequence
  Synthetic Polynucleotide
atcatcrgcccccagaaaacagg

SEQ ID NO: 3940 - DNA, 23 bp, Artificial Sequence
  Synthetic Polynucleotide
ccctatgcctttactgccyggcc

SEQ ID NO: 3941 - DNA, 23 bp, Artificial Sequence
  Synthetic Polynucleotide
cctatgcctttactgccyggcct

SEQ ID NO: 3942 - DNA, 23 bp, Artificial Sequence
  Synthetic Polynucleotide
gttgtrgcggagaagggcagtgg

SEQ ID NO: 3943 - DNA, 23 bp, Artificial Sequence
  Synthetic Polynucleotide
cgcrctacgtggtctccatgggg

SEQ ID NO: 3944 - DNA, 23 bp, Artificial Sequence
  Synthetic Polynucleotide
ccgcrctacgtggtctccatggg

SEQ ID NO: 3945 - DNA, 23 bp, Artificial Sequence
  Synthetic Polynucleotide
gccgcrctacgtggtctccatgg

SEQ ID NO: 3946 - DNA, 23 bp, Artificial Sequence
  Synthetic Polynucleotide
gctgcrccggtacccatccgggg

SEQ ID NO: 3947 - DNA, 23 bp, Artificial Sequence
  Synthetic Polynucleotide
cgctgcrccggtacccatccggg

SEQ ID NO: 3948 - DNA, 23 bp, Artificial Sequence
  Synthetic Polynucleotide
gcgctgcrccggtacccatccgg

SEQ ID NO: 3949 - DNA, 23 bp, Artificial Sequence
  Synthetic Polynucleotide
cctgttccgggaacyggccacca

SEQ ID NO: 3950 - DNA, 23 bp, Artificial Sequence
  Synthetic Polynucleotide
ccggccaccatcaactaccygtt

SEQ ID NO: 3951 - DNA, 23 bp, Artificial Sequence
  Synthetic Polynucleotide
ccaccatcaactaccygttcgag

SEQ ID NO: 3952 - DNA, 23 bp, Artificial Sequence
  Synthetic Polynucleotide
ccgcgacctgcgcctggyggcgg

SEQ ID NO: 3953 - DNA, 23 bp, Artificial Sequence
  Synthetic Polynucleotide
cgctacrgaagtggggtcagcgg

SEQ ID NO: 3954 - DNA, 23 bp, Artificial Sequence
  Synthetic Polynucleotide
ctgrggaggctgtagggtttggg

SEQ ID NO: 3955 - DNA, 23 bp, Artificial Sequence
  Synthetic Polynucleotide
tctgrggaggctgtagggtttgg

SEQ ID NO: 3956 - DNA, 23 bp, Artificial Sequence
  Synthetic Polynucleotide
gcctcatcrtgtgtggccatggg

SEQ ID NO: 3957 - DNA, 23 bp, Artificial Sequence
  Synthetic Polynucleotide
cctccgcagctatgatgyctgtg

SEQ ID NO: 3958 - DNA, 23 bp, Artificial Sequence
  Synthetic Polynucleotide
ccgcagctatgatgyctgtgata

SEQ ID NO: 3959 - DNA, 23 bp, Artificial Sequence
  Synthetic Polynucleotide
ccctgagctcgtggacyctgtgg

SEQ ID NO: 3960 - DNA, 23 bp, Artificial Sequence
  Synthetic Polynucleotide
cctgagctcgtggacyctgtggt

SEQ ID NO: 3961 - DNA, 23 bp, Artificial Sequence
  Synthetic Polynucleotide
ccccaccacaatacyaaacatct

SEQ ID NO: 3962 - DNA, 23 bp, Artificial Sequence
  Synthetic Polynucleotide
ccctaaagaaggttgcgyagtta

SEQ ID NO: 3963 - DNA, 23 bp, Artificial Sequence
  Synthetic Polynucleotide
cctaaagaaggttgcgyagttag

SEQ ID NO: 3964 - DNA, 23 bp, Artificial Sequence
  Synthetic Polynucleotide
cccccccgatttgcygacaagcc

SEQ ID NO: 3965 - DNA, 23 bp, Artificial Sequence
  Synthetic Polynucleotide
ccagcggaacctccttyagatga

SEQ ID NO: 3966 - DNA, 23 bp, Artificial Sequence
  Synthetic Polynucleotide
ccggactctggggctcygagaaa

SEQ ID NO: 3967 - DNA, 23 bp, Artificial Sequence
  Synthetic Polynucleotide
ccgcagaggctgagyaggaaatg

SEQ ID NO: 3968 - DNA, 23 bp, Artificial Sequence
  Synthetic Polynucleotide
cccgtggaatgaaatcygaaaca

SEQ ID NO: 3969 - DNA, 23 bp, Artificial Sequence
  Synthetic Polynucleotide
ccgtggaatgaaatcygaaacat

SEQ ID NO: 3970 - DNA, 23 bp, Artificial Sequence
  Synthetic Polynucleotide
cctgcagaatccggayaatcaga

SEQ ID NO: 3971 - DNA, 23 bp, Artificial Sequence
  Synthetic Polynucleotide
ccttcttattacagatygattga

SEQ ID NO: 3972 - DNA, 23 bp, Artificial Sequence
  Synthetic Polynucleotide
ccgccgccgcccttgyagccgcc

SEQ ID NO: 3973 - DNA, 23 bp, Artificial Sequence
  Synthetic Polynucleotide
gttcagrtaagcatgttttatgg

SEQ ID NO: 3974 - DNA, 23 bp, Artificial Sequence
  Synthetic Polynucleotide
ccttctctttaatgcaygaatag

SEQ ID NO: 3975 - DNA, 23 bp, Artificial Sequence
  Synthetic Polynucleotide
cctcggttaaaatcagaaygagc

SEQ ID NO: 3976 - DNA, 23 bp, Artificial Sequence
  Synthetic Polynucleotide
ccacctttaatcctayaatctca

SEQ ID NO: 3977 - DNA, 23 bp, Artificial Sequence
  Synthetic Polynucleotide
ccttgttcatcacctygagatgt

SEQ ID NO: 3978 - DNA, 23 bp, Artificial Sequence
  Synthetic Polynucleotide
ccgctacaaaatgaagcgcyagg

SEQ ID NO: 3979 - DNA, 23 bp, Artificial Sequence
  Synthetic Polynucleotide
cctggaacagcagcagygcagcc

SEQ ID NO: 3980 - DNA, 23 bp, Artificial Sequence
  Synthetic Polynucleotide
ccagcgtgctgaaactcaygtcc

SEQ ID NO: 3981 - DNA, 23 bp, Artificial Sequence
  Synthetic Polynucleotide
cccccgaacgcgacyagctggcc

SEQ ID NO: 3982 - DNA, 23 bp, Artificial Sequence
  Synthetic Polynucleotide
ccgcctgcccgcaggatcgyggt

SEQ ID NO: 3983 - DNA, 23 bp, Artificial Sequence
  Synthetic Polynucleotide
cctgcccgcaggatcgyggtgcc

SEQ ID NO: 3984 - DNA, 23 bp, Artificial Sequence
  Synthetic Polynucleotide
ccgccgccgccgcctgccygcag

SEQ ID NO: 3985 - DNA, 23 bp, Artificial Sequence
  Synthetic Polynucleotide
ccgccgccgcctgccygcaggat

SEQ ID NO: 3986 - DNA, 23 bp, Artificial Sequence
  Synthetic Polynucleotide
cctctccaggagctcatcygagt

SEQ ID NO: 3987 - DNA, 23 bp, Artificial Sequence
  Synthetic Polynucleotide
ccaagaccaccaccgyggtgtac

SEQ ID NO: 3988 - DNA, 23 bp, Artificial Sequence
  Synthetic Polynucleotide
ccacgagacctgtggycctggag

SEQ ID NO: 3989 - DNA, 23 bp, Artificial Sequence
  Synthetic Polynucleotide
acagctctragagtgaagacagg

SEQ ID NO: 3990 - DNA, 23 bp, Artificial Sequence
  Synthetic Polynucleotide
gaartggttctccttgcttgtgg

SEQ ID NO: 3991 - DNA, 23 bp, Artificial Sequence
  Synthetic Polynucleotide
cctgacagtgataaacgcygaga

SEQ ID NO: 3992 - DNA, 23 bp, Artificial Sequence
  Synthetic Polynucleotide
ctgccrgcagctgcagtgcatgg

SEQ ID NO: 3993 - DNA, 23 bp, Artificial Sequence
  Synthetic Polynucleotide
cccggggtggcggaccgcytcat

SEQ ID NO: 3994 - DNA, 23 bp, Artificial Sequence
  Synthetic Polynucleotide
ccggggtggcggaccgcytcatc

SEQ ID NO: 3995 - DNA, 23 bp, Artificial Sequence
  Synthetic Polynucleotide
acctgatcrgatggggctcctgg

SEQ ID NO: 3996 - DNA, 23 bp, Artificial Sequence
  Synthetic Polynucleotide
cgctcgtrctccgtgcccgaggg

SEQ ID NO: 3997 - DNA, 23 bp, Artificial Sequence
  Synthetic Polynucleotide
gcgctcgtrctccgtgcccgagg

SEQ ID NO: 3998 - DNA, 23 bp, Artificial Sequence
  Synthetic Polynucleotide
ccatcatgcatgcgggcatycag

SEQ ID NO: 3999 - DNA, 23 bp, Artificial Sequence
  Synthetic Polynucleotide
gctgcccrcctggctgtggaggg

SEQ ID NO: 4000 - DNA, 23 bp, Artificial Sequence
  Synthetic Polynucleotide
ggctgcccrcctggctgtggagg

SEQ ID NO: 4001 - DNA, 23 bp, Artificial Sequence
  Synthetic Polynucleotide
gagtrtctgaagggttatgcagg

SEQ ID NO: 4002 - DNA, 23 bp, Artificial Sequence
  Synthetic Polynucleotide
cccctgatcctggctgccygcct

SEQ ID NO: 4003 - DNA, 23 bp, Artificial Sequence
  Synthetic Polynucleotide
ccctgatcctggctgccygcctg

SEQ ID NO: 4004 - DNA, 23 bp, Artificial Sequence
  Synthetic Polynucleotide
cctgatcctggctgccygcctgg

SEQ ID NO: 4005 - DNA, 23 bp, Artificial Sequence
  Synthetic Polynucleotide
ccctaaaggcagtattgccyaac

SEQ ID NO: 4006 - DNA, 23 bp, Artificial Sequence
  Synthetic Polynucleotide
cctaaaggcagtattgccyaacc

SEQ ID NO: 4007 - DNA, 23 bp, Artificial Sequence
  Synthetic Polynucleotide
ccccacacccccttcayagcaca

SEQ ID NO: 4008 - DNA, 23 bp, Artificial Sequence
  Synthetic Polynucleotide
cccacacccccttcayagcacag

SEQ ID NO: 4009 - DNA, 23 bp, Artificial Sequence
  Synthetic Polynucleotide
ccacacccccttcayagcacagt

SEQ ID NO: 4010 - DNA, 23 bp, Artificial Sequence
  Synthetic Polynucleotide
ccgggtgggtgagccctgcygcc

SEQ ID NO: 4011 - DNA, 23 bp, Artificial Sequence
  Synthetic Polynucleotide
ccacctgccatgacygcgtggct

SEQ ID NO: 4012 - DNA, 23 bp, Artificial Sequence
  Synthetic Polynucleotide
gcctrtgtactttgtcctggagg

SEQ ID NO: 4013 - DNA, 23 bp, Artificial Sequence
  Synthetic Polynucleotide
tccgcctrtgtactttgtcctgg

SEQ ID NO: 4014 - DNA, 23 bp, Artificial Sequence
  Synthetic Polynucleotide
ttaaacrtcaagaggtaagttgg

SEQ ID NO: 4015 - DNA, 23 bp, Artificial Sequence
  Synthetic Polynucleotide
ccagtgaaaagcgaatatycctc

SEQ ID NO: 4016 - DNA, 23 bp, Artificial Sequence
  Synthetic Polynucleotide
cccccagatagacttaygatctg

SEQ ID NO: 4017 - DNA, 23 bp, Artificial Sequence
  Synthetic Polynucleotide
ccccagatagacttaygatctgt

SEQ ID NO: 4018 - DNA, 23 bp, Artificial Sequence
  Synthetic Polynucleotide
cccagatagacttaygatctgta

SEQ ID NO: 4019 - DNA, 23 bp, Artificial Sequence
  Synthetic Polynucleotide
cccacccgcaacgacgccaygac

SEQ ID NO: 4020 - DNA, 23 bp, Artificial Sequence
  Synthetic Polynucleotide
ccacccgcaacgacgccaygact

SEQ ID NO: 4021 - DNA, 23 bp, Artificial Sequence
  Synthetic Polynucleotide
cccgcaacgacgccaygactgca

SEQ ID NO: 4022 - DNA, 23 bp, Artificial Sequence
  Synthetic Polynucleotide
ccgcaacgacgccaygactgcag

SEQ ID NO: 4023 - DNA, 23 bp, Artificial Sequence
  Synthetic Polynucleotide
ccaaggccggccggctgtgyagg

SEQ ID NO: 4024 - DNA, 23 bp, Artificial Sequence
  Synthetic Polynucleotide
tggattragggtcccccagaggg

SEQ ID NO: 4025 - DNA, 23 bp, Artificial Sequence
  Synthetic Polynucleotide
gtggattragggtcccccagagg

SEQ ID NO: 4026 - DNA, 23 bp, Artificial Sequence
  Synthetic Polynucleotide
ccctgctgcctctgtggccygct

SEQ ID NO: 4027 - DNA, 23 bp, Artificial Sequence
  Synthetic Polynucleotide
cctgctgcctctgtggccygctt

SEQ ID NO: 4028 - DNA, 23 bp, Artificial Sequence
  Synthetic Polynucleotide
ccctrgtgggacacctcctctgg

SEQ ID NO: 4029 - DNA, 23 bp, Artificial Sequence
  Synthetic Polynucleotide
ccagacgtgccgggcctgyagtg

SEQ ID NO: 4030 - DNA, 23 bp, Artificial Sequence
  Synthetic Polynucleotide
tcggttccrggcattggcggtgg

SEQ ID NO: 4031 - DNA, 23 bp, Artificial Sequence
  Synthetic Polynucleotide
tacrgcggaggctcatctacagg

SEQ ID NO: 4032 - DNA, 23 bp, Artificial Sequence
  Synthetic Polynucleotide
tcaggaraggggagatgtgatgg

SEQ ID NO: 4033 - DNA, 23 bp, Artificial Sequence
  Synthetic Polynucleotide
tggaargtaaatgttcatgtggg

SEQ ID NO: 4034 - DNA, 23 bp, Artificial Sequence
  Synthetic Polynucleotide
gtggaargtaaatgttcatgtgg

SEQ ID NO: 4035 - DNA, 23 bp, Artificial Sequence
  Synthetic Polynucleotide
ccttgagctggagatygtacaaa

SEQ ID NO: 4036 - DNA, 23 bp, Artificial Sequence
  Synthetic Polynucleotide
gtgccccrtgtgcggggacaagg

SEQ ID NO: 4037 - DNA, 23 bp, Artificial Sequence
  Synthetic Polynucleotide
ggggtrgccggaacaagtttggg

SEQ ID NO: 4038 - DNA, 23 bp, Artificial Sequence
  Synthetic Polynucleotide
aggggtrgccggaacaagtttgg

SEQ ID NO: 4039 - DNA, 23 bp, Artificial Sequence
  Synthetic Polynucleotide
ggcgggrgcacccccatcggggg

SEQ ID NO: 4040 - DNA, 23 bp, Artificial Sequence
  Synthetic Polynucleotide
cggcgggrgcacccccatcgggg

SEQ ID NO: 4041 - DNA, 23 bp, Artificial Sequence
  Synthetic Polynucleotide
gcggcgggrgcacccccatcggg

SEQ ID NO: 4042 - DNA, 23 bp, Artificial Sequence
  Synthetic Polynucleotide
catrgactattcgtacgacgagg

SEQ ID NO: 4043 - DNA, 23 bp, Artificial Sequence
  Synthetic Polynucleotide
ccgatgggggtgcccccgcygcc

SEQ ID NO: 4044 - DNA, 23 bp, Artificial Sequence
  Synthetic Polynucleotide
aaagrtatggatttcttatgtgg

SEQ ID NO: 4045 - DNA, 23 bp, Artificial Sequence
  Synthetic Polynucleotide
ggcccragtcttcccttacatgg

SEQ ID NO: 4046 - DNA, 23 bp, Artificial Sequence
  Synthetic Polynucleotide
agtaaatrggaagccagtgttgg

SEQ ID NO: 4047 - DNA, 23 bp, Artificial Sequence
  Synthetic Polynucleotide
taggaccraatcattgatgctgg

SEQ ID NO: 4048 - DNA, 23 bp, Artificial Sequence
  Synthetic Polynucleotide
cccctaggcggggctgcygaaat

SEQ ID NO: 4049 - DNA, 23 bp, Artificial Sequence
  Synthetic Polynucleotide
ccctaggcggggctgcygaaatc

SEQ ID NO: 4050 - DNA, 23 bp, Artificial Sequence
  Synthetic Polynucleotide
cctaggcggggctgcygaaatca

SEQ ID NO: 4051 - DNA, 23 bp, Artificial Sequence
  Synthetic Polynucleotide
ccttctagcccgaggtygatcta

SEQ ID NO: 4052 - DNA, 23 bp, Artificial Sequence
  Synthetic Polynucleotide
ccaaggaagcgaaaaygacagag

SEQ ID NO: 4053 - DNA, 23 bp, Artificial Sequence
  Synthetic Polynucleotide
cccaaaaagagctaagayagctg

SEQ ID NO: 4054 - DNA, 23 bp, Artificial Sequence
  Synthetic Polynucleotide
ccaaaaagagctaagayagctgc

SEQ ID NO: 4055 - DNA, 23 bp, Artificial Sequence
  Synthetic Polynucleotide
cccaaaggaaactatgctyggtt

SEQ ID NO: 4056 - DNA, 23 bp, Artificial Sequence
  Synthetic Polynucleotide
ccaaaggaaactatgctyggttc

SEQ ID NO: 4057 - DNA, 23 bp, Artificial Sequence
  Synthetic Polynucleotide
ccttttgtaagcagcatygagaa

SEQ ID NO: 4058 - DNA, 23 bp, Artificial Sequence
  Synthetic Polynucleotide
ccttcatccaaattgygagatgc

SEQ ID NO: 4059 - DNA, 23 bp, Artificial Sequence
  Synthetic Polynucleotide
cctttccccgccatcygcataag

SEQ ID NO: 4060 - DNA, 23 bp, Artificial Sequence
  Synthetic Polynucleotide
ttctcracgatactttttcaggg

SEQ ID NO: 4061 - DNA, 23 bp, Artificial Sequence
  Synthetic Polynucleotide
cttctcracgatactttttcagg

SEQ ID NO: 4062 - DNA, 23 bp, Artificial Sequence
  Synthetic Polynucleotide
cagtcctrgggctcccagactgg

SEQ ID NO: 4063 - DNA, 23 bp, Artificial Sequence
  Synthetic Polynucleotide
agctggrggagggcgcctttggg

SEQ ID NO: 4064 - DNA, 23 bp, Artificial Sequence
  Synthetic Polynucleotide
gagctggrggagggcgcctttgg

SEQ ID NO: 4065 - DNA, 23 bp, Artificial Sequence
  Synthetic Polynucleotide
cccattcgctggatgcygcccga

SEQ ID NO: 4066 - DNA, 23 bp, Artificial Sequence
  Synthetic Polynucleotide
ccattcgctggatgcygcccgag

SEQ ID NO: 4067 - DNA, 23 bp, Artificial Sequence
  Synthetic Polynucleotide
agggactrgatggagggctccgg

SEQ ID NO: 4068 - DNA, 23 bp, Artificial Sequence
  Synthetic Polynucleotide
ggccaraactggtagatggctgg

SEQ ID NO: 4069 - DNA, 23 bp, Artificial Sequence
  Synthetic Polynucleotide
ccattaagccaggggagyatggg

SEQ ID NO: 4070 - DNA, 23 bp, Artificial Sequence
  Synthetic Polynucleotide
ccttccaggggtcaccygagagg

SEQ ID NO: 4071 - DNA, 23 bp, Artificial Sequence
  Synthetic Polynucleotide
aggagctrccactgccatcgggg

SEQ ID NO: 4072 - DNA, 23 bp, Artificial Sequence
  Synthetic Polynucleotide
gaggagctrccactgccatcggg

SEQ ID NO: 4073 - DNA, 23 bp, Artificial Sequence
  Synthetic Polynucleotide
ccctgattgacaacatccygttc

SEQ ID NO: 4074 - DNA, 23 bp, Artificial Sequence
  Synthetic Polynucleotide
cctgattgacaacatccygttca

SEQ ID NO: 4075 - DNA, 23 bp, Artificial Sequence
  Synthetic Polynucleotide
cccaggtgaccatcgygacggcc

SEQ ID NO: 4076 - DNA, 23 bp, Artificial Sequence
  Synthetic Polynucleotide
ccaggtgaccatcgygacggcca

SEQ ID NO: 4077 - DNA, 23 bp, Artificial Sequence
  Synthetic Polynucleotide
tgtgaccraattctttggagagg

SEQ ID NO: 4078 - DNA, 23 bp, Artificial Sequence
  Synthetic Polynucleotide
atcractgattgaagatgaaagg

SEQ ID NO: 4079 - DNA, 23 bp, Artificial Sequence
  Synthetic Polynucleotide
ccctcttaataggcgcctytaac

SEQ ID NO: 4080 - DNA, 23 bp, Artificial Sequence
  Synthetic Polynucleotide
cctcttaataggcgcctytaact

SEQ ID NO: 4081 - DNA, 23 bp, Artificial Sequence
  Synthetic Polynucleotide
ccttcttaggcctagctyagccg

SEQ ID NO: 4082 - DNA, 23 bp, Artificial Sequence
  Synthetic Polynucleotide
tgctgraaagactagtgtgttgg

SEQ ID NO: 4083 - DNA, 23 bp, Artificial Sequence
  Synthetic Polynucleotide
ccattgtaacctttgtygaagag

SEQ ID NO: 4084 - DNA, 23 bp, Artificial Sequence
  Synthetic Polynucleotide
ccaaaggcccccaggatgayatc

SEQ ID NO: 4085 - DNA, 23 bp, Artificial Sequence
  Synthetic Polynucleotide
ttcgrgaagaaggttgacgatgg

SEQ ID NO: 4086 - DNA, 23 bp, Artificial Sequence
  Synthetic Polynucleotide
ccaagtgtggctggccatcygag

SEQ ID NO: 4087 - DNA, 23 bp, Artificial Sequence
  Synthetic Polynucleotide
accragaaccaccagctgaaagg

SEQ ID NO: 4088 - DNA, 23 bp, Artificial Sequence
  Synthetic Polynucleotide
ccaccatcatggtgcycttcggc

SEQ ID NO: 4089 - DNA, 23 bp, Artificial Sequence
  Synthetic Polynucleotide
cctgtgcaccaggcttcyggccc

SEQ ID NO: 4090 - DNA, 23 bp, Artificial Sequence
  Synthetic Polynucleotide
gtagrctttgcacttctgggagg

SEQ ID NO: 4091 - DNA, 23 bp, Artificial Sequence
  Synthetic Polynucleotide
attgtagrctttgcacttctggg

SEQ ID NO: 4092 - DNA, 23 bp, Artificial Sequence
  Synthetic Polynucleotide
tattgtagrctttgcacttctgg

SEQ ID NO: 4093 - DNA, 23 bp, Artificial Sequence
  Synthetic Polynucleotide
agaagatrctgtttaatctgagg

SEQ ID NO: 4094 - DNA, 23 bp, Artificial Sequence
  Synthetic Polynucleotide
taartgatggtcagagacttggg

SEQ ID NO: 4095 - DNA, 23 bp, Artificial Sequence
  Synthetic Polynucleotide
gtaartgatggtcagagacttgg

SEQ ID NO: 4096 - DNA, 23 bp, Artificial Sequence
  Synthetic Polynucleotide
atgatgarcgcagcgaaattcgg

SEQ ID NO: 4097 - DNA, 23 bp, Artificial Sequence
  Synthetic Polynucleotide
acaracacttggataagcatggg

SEQ ID NO: 4098 - DNA, 23 bp, Artificial Sequence
  Synthetic Polynucleotide
tacaracacttggataagcatgg

SEQ ID NO: 4099 - DNA, 23 bp, Artificial Sequence
  Synthetic Polynucleotide
ccgtgaccttctcaytctaaaaa

SEQ ID NO: 4100 - DNA, 23 bp, Artificial Sequence
  Synthetic Polynucleotide
ccacagtgtattgtytagcatgg

SEQ ID NO: 4101 - DNA, 23 bp, Artificial Sequence
  Synthetic Polynucleotide
cctggctgattacctcaygctcc

SEQ ID NO: 4102 - DNA, 23 bp, Artificial Sequence
  Synthetic Polynucleotide
ccttcaggcagctactcyaaagg

SEQ ID NO: 4103 - DNA, 23 bp, Artificial Sequence
  Synthetic Polynucleotide
gatggrcgcactgctggctgggg

SEQ ID NO: 4104 - DNA, 23 bp, Artificial Sequence
  Synthetic Polynucleotide
agatggrcgcactgctggctggg

SEQ ID NO: 4105 - DNA, 23 bp, Artificial Sequence
  Synthetic Polynucleotide
cagatggrcgcactgctggctgg

SEQ ID NO: 4106 - DNA, 23 bp, Artificial Sequence
  Synthetic Polynucleotide
cctcttggctgcactcycgtaag

SEQ ID NO: 4107 - DNA, 23 bp, Artificial Sequence
  Synthetic Polynucleotide
tctctttgragccttcctggagg

SEQ ID NO: 4108 - DNA, 23 bp, Artificial Sequence
  Synthetic Polynucleotide
agcrcctcaagtcctgcatgagg

SEQ ID NO: 4109 - DNA, 23 bp, Artificial Sequence
  Synthetic Polynucleotide
gagrtgagggcctgggaggaggg

SEQ ID NO: 4110 - DNA, 23 bp, Artificial Sequence
  Synthetic Polynucleotide
agagrtgagggcctgggaggagg

SEQ ID NO: 4111 - DNA, 23 bp, Artificial Sequence
  Synthetic Polynucleotide
cacagagrtgagggcctgggagg

SEQ ID NO: 4112 - DNA, 23 bp, Artificial Sequence
  Synthetic Polynucleotide
cgggccrgctggagtatgaaggg

SEQ ID NO: 4113 - DNA, 23 bp, Artificial Sequence
  Synthetic Polynucleotide
tcgggccrgctggagtatgaagg

SEQ ID NO: 4114 - DNA, 23 bp, Artificial Sequence
  Synthetic Polynucleotide
actcrgtacttgctgagcacggg

SEQ ID NO: 4115 - DNA, 23 bp, Artificial Sequence
  Synthetic Polynucleotide
cactcrgtacttgctgagcacgg

SEQ ID NO: 4116 - DNA, 23 bp, Artificial Sequence
  Synthetic Polynucleotide
ccaggaggtcaaggcagccyagg

SEQ ID NO: 4117 - DNA, 23 bp, Artificial Sequence
  Synthetic Polynucleotide
ccggtgctcaatcttccytgacc

SEQ ID NO: 4118 - DNA, 23 bp, Artificial Sequence
  Synthetic Polynucleotide
cccragtcgagggtgcaggtagg

SEQ ID NO: 4119 - DNA, 23 bp, Artificial Sequence
  Synthetic Polynucleotide
cttgcccragtcgagggtgcagg

SEQ ID NO: 4120 - DNA, 23 bp, Artificial Sequence
  Synthetic Polynucleotide
gggcatagraatccctctcctgg

SEQ ID NO: 4121 - DNA, 23 bp, Artificial Sequence
  Synthetic Polynucleotide
gagcagraaacgtgattttcagg

SEQ ID NO: 4122 - DNA, 23 bp, Artificial Sequence
  Synthetic Polynucleotide
ccaaaaccrtggcaccatcaggg

SEQ ID NO: 4123 - DNA, 23 bp, Artificial Sequence
  Synthetic Polynucleotide
ctcgagcrggtgagagcagctgg

SEQ ID NO: 4124 - DNA, 23 bp, Artificial Sequence
  Synthetic Polynucleotide
ccaaggagtaccgacagygaagc

SEQ ID NO: 4125 - DNA, 23 bp, Artificial Sequence
  Synthetic Polynucleotide
caggtgtgrgattatgagactgg

SEQ ID NO: 4126 - DNA, 23 bp, Artificial Sequence
  Synthetic Polynucleotide
cctcttggtcagaaaygagaccc

SEQ ID NO: 4127 - DNA, 23 bp, Artificial Sequence
  Synthetic Polynucleotide
aaarcaggccagccacaggtcgg

SEQ ID NO: 4128 - DNA, 23 bp, Artificial Sequence
  Synthetic Polynucleotide
gaggaaarcaggccagccacagg

SEQ ID NO: 4129 - DNA, 23 bp, Artificial Sequence
  Synthetic Polynucleotide
gctacracccatacacccaaagg

SEQ ID NO: 4130 - DNA, 23 bp, Artificial Sequence
  Synthetic Polynucleotide
tcctctcrggatttcttgggtgg

SEQ ID NO: 4131 - DNA, 23 bp, Artificial Sequence
  Synthetic Polynucleotide
cagcatrtccactgcggtcctgg

SEQ ID NO: 4132 - DNA, 23 bp, Artificial Sequence
  Synthetic Polynucleotide
actrgtttactgtggagtttggg

SEQ ID NO: 4133 - DNA, 23 bp, Artificial Sequence
  Synthetic Polynucleotide
tactrgtttactgtggagtttgg

SEQ ID NO: 4134 - DNA, 23 bp, Artificial Sequence
  Synthetic Polynucleotide
attacagrtatgaccttcacagg

SEQ ID NO: 4135 - DNA, 23 bp, Artificial Sequence
  Synthetic Polynucleotide
ccaaaattacactgtcayggagt

SEQ ID NO: 4136 - DNA, 23 bp, Artificial Sequence
  Synthetic Polynucleotide
cccagcttgcactggtttcygcc

SEQ ID NO: 4137 - DNA, 23 bp, Artificial Sequence
  Synthetic Polynucleotide
ccagcttgcactggtttcygcct

SEQ ID NO: 4138 - DNA, 23 bp, Artificial Sequence
  Synthetic Polynucleotide
cccatgtatacccccgaacygtg

SEQ ID NO: 4139 - DNA, 23 bp, Artificial Sequence
  Synthetic Polynucleotide
ccatgtatacccccgaacygtga

SEQ ID NO: 4140 - DNA, 23 bp, Artificial Sequence
  Synthetic Polynucleotide
cctgagcaaagtaaaygaagcac

SEQ ID NO: 4141 - DNA, 23 bp, Artificial Sequence
  Synthetic Polynucleotide
ggaaaargtgccgggggtgcggg

SEQ ID NO: 4142 - DNA, 23 bp, Artificial Sequence
  Synthetic Polynucleotide
aggaaaargtgccgggggtgcgg

SEQ ID NO: 4143 - DNA, 23 bp, Artificial Sequence
  Synthetic Polynucleotide
agtgrgaaaaactttatacctgg

SEQ ID NO: 4144 - DNA, 23 bp, Artificial Sequence
  Synthetic Polynucleotide
atttrgtaagctttccctctagg

SEQ ID NO: 4145 - DNA, 23 bp, Artificial Sequence
  Synthetic Polynucleotide
aacattrgtcttttgtgaaatgg

SEQ ID NO: 4146 - DNA, 23 bp, Artificial Sequence
  Synthetic Polynucleotide
ccctttctgatcaayaagtagaa

SEQ ID NO: 4147 - DNA, 23 bp, Artificial Sequence
  Synthetic Polynucleotide
ccaaactcgcaaagcyagcatac

SEQ ID NO: 4148 - DNA, 23 bp, Artificial Sequence
  Synthetic Polynucleotide
ccagcaaatgaaaacyaaaactt

SEQ ID NO: 4149 - DNA, 23 bp, Artificial Sequence
  Synthetic Polynucleotide
ccagtgatactaaayaattcgac

SEQ ID NO: 4150 - DNA, 23 bp, Artificial Sequence
  Synthetic Polynucleotide
cctgactctgtgtggaygcaaag

SEQ ID NO: 4151 - DNA, 23 bp, Artificial Sequence
  Synthetic Polynucleotide
agtrgaaccgcgtctgcatgggg

SEQ ID NO: 4152 - DNA, 23 bp, Artificial Sequence
  Synthetic Polynucleotide
gagtrgaaccgcgtctgcatggg

SEQ ID NO: 4153 - DNA, 23 bp, Artificial Sequence
  Synthetic Polynucleotide
cgagtrgaaccgcgtctgcatgg

SEQ ID NO: 4154 - DNA, 23 bp, Artificial Sequence
  Synthetic Polynucleotide
gagaccrgcagcatcaagccggg

SEQ ID NO: 4155 - DNA, 23 bp, Artificial Sequence
  Synthetic Polynucleotide
cgagaccrgcagcatcaagccgg

SEQ ID NO: 4156 - DNA, 23 bp, Artificial Sequence
  Synthetic Polynucleotide
cccacggctgcgtctycaagatc

SEQ ID NO: 4157 - DNA, 23 bp, Artificial Sequence
  Synthetic Polynucleotide
ccacggctgcgtctycaagatcc

SEQ ID NO: 4158 - DNA, 23 bp, Artificial Sequence
  Synthetic Polynucleotide
ccacccagggaccggccacygga

SEQ ID NO: 4159 - DNA, 23 bp, Artificial Sequence
  Synthetic Polynucleotide
cccagggaccggccacyggaatc

SEQ ID NO: 4160 - DNA, 23 bp, Artificial Sequence
  Synthetic Polynucleotide
ccagggaccggccacyggaatcg

SEQ ID NO: 4161 - DNA, 23 bp, Artificial Sequence
  Synthetic Polynucleotide
ggtatgrttttctaatcgaaggg

SEQ ID NO: 4162 - DNA, 23 bp, Artificial Sequence
  Synthetic Polynucleotide
aggtatgrttttctaatcgaagg

SEQ ID NO: 4163 - DNA, 23 bp, Artificial Sequence
  Synthetic Polynucleotide
cctggctagcgaaaagcaayaga

SEQ ID NO: 4164 - DNA, 23 bp, Artificial Sequence
  Synthetic Polynucleotide
ccagatgtgtttgccygagaaag

SEQ ID NO: 4165 - DNA, 23 bp, Artificial Sequence
  Synthetic Polynucleotide
ccgctgcccaacgccatcyggct

SEQ ID NO: 4166 - DNA, 23 bp, Artificial Sequence
  Synthetic Polynucleotide
cccttgcggagttcygcgtccga

SEQ ID NO: 4167 - DNA, 23 bp, Artificial Sequence
  Synthetic Polynucleotide
ccaggtttatgtccygttctgaa

SEQ ID NO: 4168 - DNA, 23 bp, Artificial Sequence
  Synthetic Polynucleotide
ccacatcacgctgagcayccatg

SEQ ID NO: 4169 - DNA, 23 bp, Artificial Sequence
  Synthetic Polynucleotide
cctggccagcttcatcgaayaag

SEQ ID NO: 4170 - DNA, 23 bp, Artificial Sequence
  Synthetic Polynucleotide
ccagcttcatcgaayaagtagca

SEQ ID NO: 4171 - DNA, 23 bp, Artificial Sequence
  Synthetic Polynucleotide
ccaaraaggagtggagtctttgg

SEQ ID NO: 4172 - DNA, 23 bp, Artificial Sequence
  Synthetic Polynucleotide
acaagcgartgagtcctgagggg

SEQ ID NO: 4173 - DNA, 23 bp, Artificial Sequence
  Synthetic Polynucleotide
aatrgcggcggcattacgggtgg

SEQ ID NO: 4174 - DNA, 23 bp, Artificial Sequence
  Synthetic Polynucleotide
aaaaatrgcggcggcattacggg

SEQ ID NO: 4175 - DNA, 23 bp, Artificial Sequence
  Synthetic Polynucleotide
caaaaatrgcggcggcattacgg

SEQ ID NO: 4176 - DNA, 23 bp, Artificial Sequence
  Synthetic Polynucleotide
cctgttcatcactggccytgatg

SEQ ID NO: 4177 - DNA, 23 bp, Artificial Sequence
  Synthetic Polynucleotide
ccctttccctgcagcagtgygag

SEQ ID NO: 4178 - DNA, 23 bp, Artificial Sequence
  Synthetic Polynucleotide
cctttccctgcagcagtgygagg

SEQ ID NO: 4179 - DNA, 23 bp, Artificial Sequence
  Synthetic Polynucleotide
ccaaccttcttccacaygtgccc

SEQ ID NO: 4180 - DNA, 23 bp, Artificial Sequence
  Synthetic Polynucleotide
cctgctggtcaccaagyagaaga

SEQ ID NO: 4181 - DNA, 23 bp, Artificial Sequence
  Synthetic Polynucleotide
ccaatgacaatccgcyggtcatc

SEQ ID NO: 4182 - DNA, 23 bp, Artificial Sequence
  Synthetic Polynucleotide
cccgagctgcagtggctcygagc

SEQ ID NO: 4183 - DNA, 23 bp, Artificial Sequence
  Synthetic Polynucleotide
ccgagctgcagtggctcygagcg

SEQ ID NO: 4184 - DNA, 23 bp, Artificial Sequence
  Synthetic Polynucleotide
ccacctccgggaacagcagygag

SEQ ID NO: 4185 - DNA, 23 bp, Artificial Sequence
  Synthetic Polynucleotide
cctccgggaacagcagygagagc

SEQ ID NO: 4186 - DNA, 23 bp, Artificial Sequence
  Synthetic Polynucleotide
cgggacccrcttccacagacagg

SEQ ID NO: 4187 - DNA, 23 bp, Artificial Sequence
  Synthetic Polynucleotide
ccaggagtgggaagcggyggggc

SEQ ID NO: 4188 - DNA, 23 bp, Artificial Sequence
  Synthetic Polynucleotide
cttcrcttgcatcagagctcggg

SEQ ID NO: 4189 - DNA, 23 bp, Artificial Sequence
  Synthetic Polynucleotide
tcttcrcttgcatcagagctcgg

SEQ ID NO: 4190 - DNA, 23 bp, Artificial Sequence
  Synthetic Polynucleotide
ccaccaccacctcggycacaggt

SEQ ID NO: 4191 - DNA, 23 bp, Artificial Sequence
  Synthetic Polynucleotide
ccgtcagtgagatggyctccaac

SEQ ID NO: 4192 - DNA, 23 bp, Artificial Sequence
  Synthetic Polynucleotide
cgagrtaggatgagggccaaggg

SEQ ID NO: 4193 - DNA, 23 bp, Artificial Sequence
  Synthetic Polynucleotide
acgagrtaggatgagggccaagg

SEQ ID NO: 4194 - DNA, 23 bp, Artificial Sequence
  Synthetic Polynucleotide
ctgrcggcacggcttcaacgtgg

SEQ ID NO: 4195 - DNA, 23 bp, Artificial Sequence
  Synthetic Polynucleotide
ccggagaatcacctacyacaact

SEQ ID NO: 4196 - DNA, 23 bp, Artificial Sequence
  Synthetic Polynucleotide
ccccacccaggtgcagctgygac

SEQ ID NO: 4197 - DNA, 23 bp, Artificial Sequence
  Synthetic Polynucleotide
cccacccaggtgcagctgygacc

SEQ ID NO: 4198 - DNA, 23 bp, Artificial Sequence
  Synthetic Polynucleotide
ccacccaggtgcagctgygacct

SEQ ID NO: 4199 - DNA, 23 bp, Artificial Sequence
  Synthetic Polynucleotide
cccaggtgcagctgygacctgtc

SEQ ID NO: 4200 - DNA, 23 bp, Artificial Sequence
  Synthetic Polynucleotide
ccccatttacatcatcayagagt

SEQ ID NO: 4201 - DNA, 23 bp, Artificial Sequence
  Synthetic Polynucleotide
cccatttacatcatcayagagta

SEQ ID NO: 4202 - DNA, 23 bp, Artificial Sequence
  Synthetic Polynucleotide
ccatttacatcatcayagagtat

SEQ ID NO: 4203 - DNA, 23 bp, Artificial Sequence
  Synthetic Polynucleotide
ccacccagccatccttyggtccc

SEQ ID NO: 4204 - DNA, 23 bp, Artificial Sequence
  Synthetic Polynucleotide
aagttcrtggtgccaatcagtgg

SEQ ID NO: 4205 - DNA, 23 bp, Artificial Sequence
  Synthetic Polynucleotide
ccctccccatagttacygtacac

SEQ ID NO: 4206 - DNA, 23 bp, Artificial Sequence
  Synthetic Polynucleotide
cctccccatagttacygtacacg

SEQ ID NO: 4207 - DNA, 23 bp, Artificial Sequence
  Synthetic Polynucleotide
ctgaagccragtgtttaagacgg

SEQ ID NO: 4208 - DNA, 23 bp, Artificial Sequence
  Synthetic Polynucleotide
ttggcrgggtgagtgcccacggg

SEQ ID NO: 4209 - DNA, 23 bp, Artificial Sequence
  Synthetic Polynucleotide
tttggcrgggtgagtgcccacgg

SEQ ID NO: 4210 - DNA, 23 bp, Artificial Sequence
  Synthetic Polynucleotide
ttgrtgggttacatgaagttagg

SEQ ID NO: 4211 - DNA, 23 bp, Artificial Sequence
  Synthetic Polynucleotide
tacrtaagtagcaggcgctgagg

SEQ ID NO: 4212 - DNA, 23 bp, Artificial Sequence
  Synthetic Polynucleotide
cctctcctctagggccgccyagt

SEQ ID NO: 4213 - DNA, 23 bp, Artificial Sequence
  Synthetic Polynucleotide
cctctagggccgccyagtatgct

SEQ ID NO: 4214 - DNA, 23 bp, Artificial Sequence
  Synthetic Polynucleotide
ccgggtgaatgatactgttyttg

SEQ ID NO: 4215 - DNA, 23 bp, Artificial Sequence
  Synthetic Polynucleotide
tcatgrtgtattcctcttactgg

SEQ ID NO: 4216 - DNA, 23 bp, Artificial Sequence
  Synthetic Polynucleotide
tgttgtgrggatccaggccctgg

SEQ ID NO: 4217 - DNA, 23 bp, Artificial Sequence
  Synthetic Polynucleotide
ccctggcagaaatggatyggtgg

SEQ ID NO: 4218 - DNA, 23 bp, Artificial Sequence
  Synthetic Polynucleotide
cctggcagaaatggatyggtggc

SEQ ID NO: 4219 - DNA, 23 bp, Artificial Sequence
  Synthetic Polynucleotide
cctgtgaaaccctaygagactgg

SEQ ID NO: 4220 - DNA, 23 bp, Artificial Sequence
  Synthetic Polynucleotide
ccccaagccgggggygaagtgga

SEQ ID NO: 4221 - DNA, 23 bp, Artificial Sequence
  Synthetic Polynucleotide
cctccgactcggaayggcttccg

SEQ ID NO: 4222 - DNA, 23 bp, Artificial Sequence
  Synthetic Polynucleotide
ccactacctcagctgcayctccc

SEQ ID NO: 4223 - DNA, 23 bp, Artificial Sequence
  Synthetic Polynucleotide
ccctccaactcaccttgycatgg

SEQ ID NO: 4224 - DNA, 23 bp, Artificial Sequence
  Synthetic Polynucleotide
cctccaactcaccttgycatgga

SEQ ID NO: 4225 - DNA, 23 bp, Artificial Sequence
  Synthetic Polynucleotide
ggtagraaacaaatgccaagtgg

SEQ ID NO: 4226 - DNA, 23 bp, Artificial Sequence
  Synthetic Polynucleotide
taagtrcatggtaagtataccgg

SEQ ID NO: 4227 - DNA, 23 bp, Artificial Sequence
  Synthetic Polynucleotide
ctacccrgatgcagtcctttggg

SEQ ID NO: 4228 - DNA, 23 bp, Artificial Sequence
  Synthetic Polynucleotide
gctacccrgatgcagtcctttgg

SEQ ID NO: 4229 - DNA, 23 bp, Artificial Sequence
  Synthetic Polynucleotide
ttcatgrgaacagagctgaatgg

SEQ ID NO: 4230 - DNA, 23 bp, Artificial Sequence
  Synthetic Polynucleotide
gcagragccgccacgggaccggg

SEQ ID NO: 4231 - DNA, 23 bp, Artificial Sequence
  Synthetic Polynucleotide
ggcagragccgccacgggaccgg

SEQ ID NO: 4232 - DNA, 23 bp, Artificial Sequence
  Synthetic Polynucleotide
cattgtcrgcctcctgaaagagg

SEQ ID NO: 4233 - DNA, 23 bp, Artificial Sequence
  Synthetic Polynucleotide
ccgccgttgtgttcatygagcta

SEQ ID NO: 4234 - DNA, 23 bp, Artificial Sequence
  Synthetic Polynucleotide
cccgcgccctactcggyaggtga

SEQ ID NO: 4235 - DNA, 23 bp, Artificial Sequence
  Synthetic Polynucleotide
ccgcgccctactcggyaggtgag

SEQ ID NO: 4236 - DNA, 23 bp, Artificial Sequence
  Synthetic Polynucleotide
gaggrcgcggtcaaccaccatgg

SEQ ID NO: 4237 - DNA, 23 bp, Artificial Sequence
  Synthetic Polynucleotide
cccactgaagaattcayggacaa

SEQ ID NO: 4238 - DNA, 23 bp, Artificial Sequence
  Synthetic Polynucleotide
ccactgaagaattcayggacaaa

SEQ ID NO: 4239 - DNA, 23 bp, Artificial Sequence
  Synthetic Polynucleotide
ccctgatctctctcctacaycca

SEQ ID NO: 4240 - DNA, 23 bp, Artificial Sequence
  Synthetic Polynucleotide
cctgatctctctcctacayccac

SEQ ID NO: 4241 - DNA, 23 bp, Artificial Sequence
  Synthetic Polynucleotide
ccatccagtttgagygggcgctg

SEQ ID NO: 4242 - DNA, 23 bp, Artificial Sequence
  Synthetic Polynucleotide
ccttrttccaatcccaggtaagg

SEQ ID NO: 4243 - DNA, 23 bp, Artificial Sequence
  Synthetic Polynucleotide
tctctctraaatcactgagcagg

SEQ ID NO: 4244 - DNA, 23 bp, Artificial Sequence
  Synthetic Polynucleotide
gtatragcacgagaaggacctgg

SEQ ID NO: 4245 - DNA, 23 bp, Artificial Sequence
  Synthetic Polynucleotide
ccctgtggatgaccaayaagatg

SEQ ID NO: 4246 - DNA, 23 bp, Artificial Sequence
  Synthetic Polynucleotide
cctgtggatgaccaayaagatgc

SEQ ID NO: 4247 - DNA, 23 bp, Artificial Sequence
  Synthetic Polynucleotide
cctcaccragccgcgcgtgcggg

SEQ ID NO: 4248 - DNA, 23 bp, Artificial Sequence
  Synthetic Polynucleotide
acctcaccragccgcgcgtgcgg

SEQ ID NO: 4249 - DNA, 23 bp, Artificial Sequence
  Synthetic Polynucleotide
cacrcgaagaaatcgctgtgtgg

SEQ ID NO: 4250 - DNA, 23 bp, Artificial Sequence
  Synthetic Polynucleotide
ccttacggaagcccgagtcyggg

SEQ ID NO: 4251 - DNA, 23 bp, Artificial Sequence
  Synthetic Polynucleotide
cctctgratgggcctcagcaagg

SEQ ID NO: 4252 - DNA, 23 bp, Artificial Sequence
  Synthetic Polynucleotide
cctgctcacccagtttgacygac

SEQ ID NO: 4253 - DNA, 23 bp, Artificial Sequence
  Synthetic Polynucleotide
ccggctgcgcttcctgyagctgc

SEQ ID NO: 4254 - DNA, 23 bp, Artificial Sequence
  Synthetic Polynucleotide
cctttaaagctgatcygatatgt

SEQ ID NO: 4255 - DNA, 23 bp, Artificial Sequence
  Synthetic Polynucleotide
acagtttgrgaaagtgcaggtgg

SEQ ID NO: 4256 - DNA, 23 bp, Artificial Sequence
  Synthetic Polynucleotide
cacaracagaactgtccttgtgg

SEQ ID NO: 4257 - DNA, 23 bp, Artificial Sequence
  Synthetic Polynucleotide
ttctgrtaaaggggtgattgggg

SEQ ID NO: 4258 - DNA, 23 bp, Artificial Sequence
  Synthetic Polynucleotide
tttctgrtaaaggggtgattggg

SEQ ID NO: 4259 - DNA, 23 bp, Artificial Sequence
  Synthetic Polynucleotide
atttctgrtaaaggggtgattgg

SEQ ID NO: 4260 - DNA, 23 bp, Artificial Sequence
  Synthetic Polynucleotide
acagcartgacggagaacttcgg

SEQ ID NO: 4261 - DNA, 23 bp, Artificial Sequence
  Synthetic Polynucleotide
ccagaattgatctctatttytca

SEQ ID NO: 4262 - DNA, 23 bp, Artificial Sequence
  Synthetic Polynucleotide
ccagagaaaccagttcyggtaat

SEQ ID NO: 4263 - DNA, 23 bp, Artificial Sequence
  Synthetic Polynucleotide
ccaaatccaggaccaygagatag

SEQ ID NO: 4264 - DNA, 23 bp, Artificial Sequence
  Synthetic Polynucleotide
cctggtgacgacacagagaygac

SEQ ID NO: 4265 - DNA, 23 bp, Artificial Sequence
  Synthetic Polynucleotide
ccttcaccagctcttayagaata

SEQ ID NO: 4266 - DNA, 23 bp, Artificial Sequence
  Synthetic Polynucleotide
ccttgcagggggaaygtggatca

SEQ ID NO: 4267 - DNA, 23 bp, Artificial Sequence
  Synthetic Polynucleotide
cctggatcatatcatytactctg

SEQ ID NO: 4268 - DNA, 23 bp, Artificial Sequence
  Synthetic Polynucleotide
cctcctaagatgtgggagtygag

SEQ ID NO: 4269 - DNA, 23 bp, Artificial Sequence
  Synthetic Polynucleotide
cctaagatgtgggagtygagtgg

SEQ ID NO: 4270 - DNA, 23 bp, Artificial Sequence
  Synthetic Polynucleotide
tggccrgtgagggggatattggg

SEQ ID NO: 4271 - DNA, 23 bp, Artificial Sequence
  Synthetic Polynucleotide
ctggccrgtgagggggatattgg

SEQ ID NO: 4272 - DNA, 23 bp, Artificial Sequence
  Synthetic Polynucleotide
tcggtaccragacagaagctggg

SEQ ID NO: 4273 - DNA, 23 bp, Artificial Sequence
  Synthetic Polynucleotide
ccaagggaccggagatcygcact

SEQ ID NO: 4274 - DNA, 23 bp, Artificial Sequence
  Synthetic Polynucleotide
ccaagccccggccaaygagggca

SEQ ID NO: 4275 - DNA, 23 bp, Artificial Sequence
  Synthetic Polynucleotide
ccccaaccagaacgtcyagcagg

SEQ ID NO: 4276 - DNA, 23 bp, Artificial Sequence
  Synthetic Polynucleotide
cccaaccagaacgtcyagcaggc

SEQ ID NO: 4277 - DNA, 23 bp, Artificial Sequence
  Synthetic Polynucleotide
ccaaccagaacgtcyagcaggcc

SEQ ID NO: 4278 - DNA, 23 bp, Artificial Sequence
  Synthetic Polynucleotide
tcttccragcttcagatttctgg

SEQ ID NO: 4279 - DNA, 23 bp, Artificial Sequence
  Synthetic Polynucleotide
ccagtacagccagagaagcyagg

SEQ ID NO: 4280 - DNA, 23 bp, Artificial Sequence
  Synthetic Polynucleotide
ggcrggctgtggaccgggcacgg

SEQ ID NO: 4281 - DNA, 23 bp, Artificial Sequence
  Synthetic Polynucleotide
agacgggcrggctgtggaccggg

SEQ ID NO: 4282 - DNA, 23 bp, Artificial Sequence
  Synthetic Polynucleotide
catgccgcrcatgtaggccatgg

SEQ ID NO: 4283 - DNA, 23 bp, Artificial Sequence
  Synthetic Polynucleotide
cctagaccagctggtgtggyggg

SEQ ID NO: 4284 - DNA, 23 bp, Artificial Sequence
  Synthetic Polynucleotide
ccagggtgatgctgayagggaca

SEQ ID NO: 4285 - DNA, 23 bp, Artificial Sequence
  Synthetic Polynucleotide
cctggtggagctggtgyagtact

SEQ ID NO: 4286 - DNA, 23 bp, Artificial Sequence
  Synthetic Polynucleotide
cttractgctgggatggaaaagg

SEQ ID NO: 4287 - DNA, 23 bp, Artificial Sequence
  Synthetic Polynucleotide
ccccatgctgttgaacygaccac

SEQ ID NO: 4288 - DNA, 23 bp, Artificial Sequence
  Synthetic Polynucleotide
cccatgctgttgaacygaccact

SEQ ID NO: 4289 - DNA, 23 bp, Artificial Sequence
  Synthetic Polynucleotide
ccatgctgttgaacygaccactg

SEQ ID NO: 4290 - DNA, 23 bp, Artificial Sequence
  Synthetic Polynucleotide
cctgccaatcatcatatygattg

SEQ ID NO: 4291 - DNA, 23 bp, Artificial Sequence
  Synthetic Polynucleotide
cctgcccgcaggagctgyagctg

SEQ ID NO: 4292 - DNA, 23 bp, Artificial Sequence
  Synthetic Polynucleotide
cctgcgggagcgagcggagyagg

SEQ ID NO: 4293 - DNA, 23 bp, Artificial Sequence
  Synthetic Polynucleotide
cccaagaggctgcgygactgcgg

SEQ ID NO: 4294 - DNA, 23 bp, Artificial Sequence
  Synthetic Polynucleotide
caartgagatttagctggagagg

SEQ ID NO: 4295 - DNA, 23 bp, Artificial Sequence
  Synthetic Polynucleotide
acccacaartgagatttagctgg

SEQ ID NO: 4296 - DNA, 23 bp, Artificial Sequence
  Synthetic Polynucleotide
gttgactrctgcccactgcttgg

SEQ ID NO: 4297 - DNA, 23 bp, Artificial Sequence
  Synthetic Polynucleotide
ttactgtcrtaaccccgataggg

SEQ ID NO: 4298 - DNA, 23 bp, Artificial Sequence
  Synthetic Polynucleotide
cccccagaaacacatgygacttt

SEQ ID NO: 4299 - DNA, 23 bp, Artificial Sequence
  Synthetic Polynucleotide
ccccagaaacacatgygactttt

SEQ ID NO: 4300 - DNA, 23 bp, Artificial Sequence
  Synthetic Polynucleotide
cccagaaacacatgygacttttc

SEQ ID NO: 4301 - DNA, 23 bp, Artificial Sequence
  Synthetic Polynucleotide
cccatggaatgctttcyctggca

SEQ ID NO: 4302 - DNA, 23 bp, Artificial Sequence
  Synthetic Polynucleotide
ccatggaatgctttcyctggcaa

SEQ ID NO: 4303 - DNA, 23 bp, Artificial Sequence
  Synthetic Polynucleotide
ccttccacctgtttattgytgca

SEQ ID NO: 4304 - DNA, 23 bp, Artificial Sequence
  Synthetic Polynucleotide
ccacctgtttattgytgcatttg

SEQ ID NO: 4305 - DNA, 23 bp, Artificial Sequence
  Synthetic Polynucleotide
cctggtgtttgcctgctytgctg

SEQ ID NO: 4306 - DNA, 23 bp, Artificial Sequence
  Synthetic Polynucleotide
ctactccrtgacagcgcctgagg

SEQ ID NO: 4307 - DNA, 23 bp, Artificial Sequence
  Synthetic Polynucleotide
ccaccatgatcctgtygatcatc

SEQ ID NO: 4308 - DNA, 23 bp, Artificial Sequence
  Synthetic Polynucleotide
ccatttccagactgygagaggcc

SEQ ID NO: 4309 - DNA, 23 bp, Artificial Sequence
  Synthetic Polynucleotide
ctgagragttctttctcaagtgg

SEQ ID NO: 4310 - DNA, 23 bp, Artificial Sequence
  Synthetic Polynucleotide
tgtatraagggtacccactctgg

SEQ ID NO: 4311 - DNA, 23 bp, Artificial Sequence
  Synthetic Polynucleotide
ccaagcggaggattactcgyagc

SEQ ID NO: 4312 - DNA, 23 bp, Artificial Sequence
  Synthetic Polynucleotide
tgtccrgctggtggctgctgtgg

SEQ ID NO: 4313 - DNA, 23 bp, Artificial Sequence
  Synthetic Polynucleotide
gtcagrgtggctggcccagcagg

SEQ ID NO: 4314 - DNA, 23 bp, Artificial Sequence
  Synthetic Polynucleotide
tgcragtccacaaagatggtggg

SEQ ID NO: 4315 - DNA, 23 bp, Artificial Sequence
  Synthetic Polynucleotide
atgcragtccacaaagatggtgg

SEQ ID NO: 4316 - DNA, 23 bp, Artificial Sequence
  Synthetic Polynucleotide
gccatgcragtccacaaagatgg

SEQ ID NO: 4317 - DNA, 23 bp, Artificial Sequence
  Synthetic Polynucleotide
cctcacgtacccagtcayctcca

SEQ ID NO: 4318 - DNA, 23 bp, Artificial Sequence
  Synthetic Polynucleotide
ccccacagcggacatcgccygca

SEQ ID NO: 4319 - DNA, 23 bp, Artificial Sequence
  Synthetic Polynucleotide
cccacagcggacatcgccygcag

SEQ ID NO: 4320 - DNA, 23 bp, Artificial Sequence
  Synthetic Polynucleotide
ccacagcggacatcgccygcagc

SEQ ID NO: 4321 - DNA, 23 bp, Artificial Sequence
  Synthetic Polynucleotide
gaccrgatagtctttcggcgggg

SEQ ID NO: 4322 - DNA, 23 bp, Artificial Sequence
  Synthetic Polynucleotide
tgaccrgatagtctttcggcggg

SEQ ID NO: 4323 - DNA, 23 bp, Artificial Sequence
  Synthetic Polynucleotide
atgaccrgatagtctttcggcgg

SEQ ID NO: 4324 - DNA, 23 bp, Artificial Sequence
  Synthetic Polynucleotide
ccaaccgcctgcatgacyggata

SEQ ID NO: 4325 - DNA, 23 bp, Artificial Sequence
  Synthetic Polynucleotide
cctgcttgcttccggctccygag

SEQ ID NO: 4326 - DNA, 23 bp, Artificial Sequence
  Synthetic Polynucleotide
ggtrggctagctcgccgcttcgg

SEQ ID NO: 4327 - DNA, 23 bp, Artificial Sequence
  Synthetic Polynucleotide
gttctcacraatgtccttcatgg

SEQ ID NO: 4328 - DNA, 23 bp, Artificial Sequence
  Synthetic Polynucleotide
gaagctrcttagccctgagatgg

SEQ ID NO: 4329 - DNA, 23 bp, Artificial Sequence
  Synthetic Polynucleotide
gccrggctgtggagcccacatgg

SEQ ID NO: 4330 - DNA, 23 bp, Artificial Sequence
  Synthetic Polynucleotide
ccarcaagttgcccatcgagggg

SEQ ID NO: 4331 - DNA, 23 bp, Artificial Sequence
  Synthetic Polynucleotide
gccarcaagttgcccatcgaggg

SEQ ID NO: 4332 - DNA, 23 bp, Artificial Sequence
  Synthetic Polynucleotide
agccarcaagttgcccatcgagg

SEQ ID NO: 4333 - DNA, 23 bp, Artificial Sequence
  Synthetic Polynucleotide
agcccggcragtgatggtgccgg

SEQ ID NO: 4334 - DNA, 23 bp, Artificial Sequence
  Synthetic Polynucleotide
tgccrgcaccatcactcgccggg

SEQ ID NO: 4335 - DNA, 23 bp, Artificial Sequence
  Synthetic Polynucleotide
ctgccrgcaccatcactcgccgg

SEQ ID NO: 4336 - DNA, 23 bp, Artificial Sequence
  Synthetic Polynucleotide
ccaggtagcgaacctygtcatgg

SEQ ID NO: 4337 - DNA, 23 bp, Artificial Sequence
  Synthetic Polynucleotide
ccggcaccatcactcgcygggct

SEQ ID NO: 4338 - DNA, 23 bp, Artificial Sequence
  Synthetic Polynucleotide
cctggtgcagccagyggctggtg

SEQ ID NO: 4339 - DNA, 23 bp, Artificial Sequence
  Synthetic Polynucleotide
ccccctggaggtccctaytggtg

SEQ ID NO: 4340 - DNA, 23 bp, Artificial Sequence
  Synthetic Polynucleotide
cccctggaggtccctaytggtgc

SEQ ID NO: 4341 - DNA, 23 bp, Artificial Sequence
  Synthetic Polynucleotide
ccctggaggtccctaytggtgcc

SEQ ID NO: 4342 - DNA, 23 bp, Artificial Sequence
  Synthetic Polynucleotide
cctggaggtccctaytggtgcca

SEQ ID NO: 4343 - DNA, 23 bp, Artificial Sequence
  Synthetic Polynucleotide
ccctgcatggacccygggcccca

SEQ ID NO: 4344 - DNA, 23 bp, Artificial Sequence
  Synthetic Polynucleotide
ccagagttgccaaccccyggctg

SEQ ID NO: 4345 - DNA, 23 bp, Artificial Sequence
  Synthetic Polynucleotide
cctttgctctaggtccataytac

SEQ ID NO: 4346 - DNA, 23 bp, Artificial Sequence
  Synthetic Polynucleotide
tctcgcccraccccaacctccgg

SEQ ID NO: 4347 - DNA, 23 bp, Artificial Sequence
  Synthetic Polynucleotide
gaactcrggtggggagaaggagg

SEQ ID NO: 4348 - DNA, 23 bp, Artificial Sequence
  Synthetic Polynucleotide
tctttgacrctgcctacttcggg

SEQ ID NO: 4349 - DNA, 23 bp, Artificial Sequence
  Synthetic Polynucleotide
cctgacctaccttcagaagygag

SEQ ID NO: 4350 - DNA, 23 bp, Artificial Sequence
  Synthetic Polynucleotide
cctaccttcagaagygaggactg

SEQ ID NO: 4351 - DNA, 23 bp, Artificial Sequence
  Synthetic Polynucleotide
ccccgagtggctcttcygaatct

SEQ ID NO: 4352 - DNA, 23 bp, Artificial Sequence
  Synthetic Polynucleotide
cccgagtggctcttcygaatcta

SEQ ID NO: 4353 - DNA, 23 bp, Artificial Sequence
  Synthetic Polynucleotide
ccgagtggctcttcygaatctac

SEQ ID NO: 4354 - DNA, 23 bp, Artificial Sequence
  Synthetic Polynucleotide
cttgrgaggtaggagtcatcagg

SEQ ID NO: 4355 - DNA, 23 bp, Artificial Sequence
  Synthetic Polynucleotide
ccacccgctccctgaacaygtga

SEQ ID NO: 4356 - DNA, 23 bp, Artificial Sequence
  Synthetic Polynucleotide
cccgctccctgaacaygtgagtg

SEQ ID NO: 4357 - DNA, 23 bp, Artificial Sequence
  Synthetic Polynucleotide
ccgctccctgaacaygtgagtgt

SEQ ID NO: 4358 - DNA, 23 bp, Artificial Sequence
  Synthetic Polynucleotide
ttacgrgatggttggtcccctgg

SEQ ID NO: 4359 - DNA, 23 bp, Artificial Sequence
  Synthetic Polynucleotide
cccaggtcctgctgygaggaggc

SEQ ID NO: 4360 - DNA, 23 bp, Artificial Sequence
  Synthetic Polynucleotide
cccagagacactcaygttcaggg

SEQ ID NO: 4361 - DNA, 23 bp, Artificial Sequence
  Synthetic Polynucleotide
ccagrtgagcaagtgcccgcagg

SEQ ID NO: 4362 - DNA, 23 bp, Artificial Sequence
  Synthetic Polynucleotide
cggctrccgccgctcggatgagg

SEQ ID NO: 4363 - DNA, 23 bp, Artificial Sequence
  Synthetic Polynucleotide
ccggaggcagagagaaaaayggg

SEQ ID NO: 4364 - DNA, 23 bp, Artificial Sequence
  Synthetic Polynucleotide
cctctgcaactctgcytctgata

SEQ ID NO: 4365 - DNA, 23 bp, Artificial Sequence
  Synthetic Polynucleotide
cctgcacccggtgctcygagagc

SEQ ID NO: 4366 - DNA, 23 bp, Artificial Sequence
  Synthetic Polynucleotide
ccggagaagcgttcaytcgaggc

SEQ ID NO: 4367 - DNA, 23 bp, Artificial Sequence
  Synthetic Polynucleotide
tcgctccrtggaggctgtgcagg

SEQ ID NO: 4368 - DNA, 23 bp, Artificial Sequence
  Synthetic Polynucleotide
ccatggacagtctctgcygtgga

SEQ ID NO: 4369 - DNA, 23 bp, Artificial Sequence
  Synthetic Polynucleotide
cctgaagaaaatgctgattygac

SEQ ID NO: 4370 - DNA, 23 bp, Artificial Sequence
  Synthetic Polynucleotide
ctcgctgragggactgcagccgg

SEQ ID NO: 4371 - DNA, 23 bp, Artificial Sequence
  Synthetic Polynucleotide
ccttcccagtggacacayaaagg

SEQ ID NO: 4372 - DNA, 23 bp, Artificial Sequence
  Synthetic Polynucleotide
cccaggaggagcagaygggctgc

SEQ ID NO: 4373 - DNA, 23 bp, Artificial Sequence
  Synthetic Polynucleotide
ccaggaggagcagaygggctgcc

SEQ ID NO: 4374 - DNA, 23 bp, Artificial Sequence
  Synthetic Polynucleotide
cagcrgaagaaagaagcactggg

SEQ ID NO: 4375 - DNA, 23 bp, Artificial Sequence
  Synthetic Polynucleotide
tcagcrgaagaaagaagcactgg

SEQ ID NO: 4376 - DNA, 23 bp, Artificial Sequence
  Synthetic Polynucleotide
cagrtgagtggggtcggccgggg

SEQ ID NO: 4377 - DNA, 23 bp, Artificial Sequence
  Synthetic Polynucleotide
ccagrtgagtggggtcggccggg

SEQ ID NO: 4378 - DNA, 23 bp, Artificial Sequence
  Synthetic Polynucleotide
cccagrtgagtggggtcggccgg

SEQ ID NO: 4379 - DNA, 23 bp, Artificial Sequence
  Synthetic Polynucleotide
ccagaagcataacattyaagcgc

SEQ ID NO: 4380 - DNA, 23 bp, Artificial Sequence
  Synthetic Polynucleotide
cacrtacgtaagggccatggtgg

SEQ ID NO: 4381 - DNA, 23 bp, Artificial Sequence
  Synthetic Polynucleotide
tgccacrtacgtaagggccatgg

SEQ ID NO: 4382 - DNA, 23 bp, Artificial Sequence
  Synthetic Polynucleotide
actgtgrctccctcctctacggg

SEQ ID NO: 4383 - DNA, 23 bp, Artificial Sequence
  Synthetic Polynucleotide
cactgtgrctccctcctctacgg

SEQ ID NO: 4384 - DNA, 23 bp, Artificial Sequence
  Synthetic Polynucleotide
ctctacrggcttgtgcaccaggg

SEQ ID NO: 4385 - DNA, 23 bp, Artificial Sequence
  Synthetic Polynucleotide
cctctacrggcttgtgcaccagg

SEQ ID NO: 4386 - DNA, 23 bp, Artificial Sequence
  Synthetic Polynucleotide
ctctacgrgcttgtgcaccaggg

SEQ ID NO: 4387 - DNA, 23 bp, Artificial Sequence
  Synthetic Polynucleotide
cctctacgrgcttgtgcaccagg

SEQ ID NO: 4388 - DNA, 23 bp, Artificial Sequence
  Synthetic Polynucleotide
aatrctcctgtgagtgacctggg

SEQ ID NO: 4389 - DNA, 23 bp, Artificial Sequence
  Synthetic Polynucleotide
aaatrctcctgtgagtgacctgg

SEQ ID NO: 4390 - DNA, 23 bp, Artificial Sequence
  Synthetic Polynucleotide
aaargcagttttgggaaggttgg

SEQ ID NO: 4391 - DNA, 23 bp, Artificial Sequence
  Synthetic Polynucleotide
aggaaaargcagttttgggaagg

SEQ ID NO: 4392 - DNA, 23 bp, Artificial Sequence
  Synthetic Polynucleotide
ccaggacccccggaacaaayaca

SEQ ID NO: 4393 - DNA, 23 bp, Artificial Sequence
  Synthetic Polynucleotide
gggcracagtggggggcccatgg

SEQ ID NO: 4394 - DNA, 23 bp, Artificial Sequence
  Synthetic Polynucleotide
aaaatrtggatgacacagtaagg

SEQ ID NO: 4395 - DNA, 23 bp, Artificial Sequence
  Synthetic Polynucleotide
ccaccgacaatgacatcgyactg

SEQ ID NO: 4396 - DNA, 23 bp, Artificial Sequence
  Synthetic Polynucleotide
ccgacaatgacatcgyactgctg

SEQ ID NO: 4397 - DNA, 23 bp, Artificial Sequence
  Synthetic Polynucleotide
cccagcccgccaccctctygcag

SEQ ID NO: 4398 - DNA, 23 bp, Artificial Sequence
  Synthetic Polynucleotide
ccagcccgccaccctctygcaga

SEQ ID NO: 4399 - DNA, 23 bp, Artificial Sequence
  Synthetic Polynucleotide
ccgtcacagcagcctggagyggg

SEQ ID NO: 4400 - DNA, 23 bp, Artificial Sequence
  Synthetic Polynucleotide
cacrggctcgctcctgggccagg

SEQ ID NO: 4401 - DNA, 23 bp, Artificial Sequence
  Synthetic Polynucleotide
tgccgcacrggctcgctcctggg

SEQ ID NO: 4402 - DNA, 23 bp, Artificial Sequence
  Synthetic Polynucleotide
ccttgaaccagagctccygggag

SEQ ID NO: 4403 - DNA, 23 bp, Artificial Sequence
  Synthetic Polynucleotide
cctgacagagtacaaygccaaac

SEQ ID NO: 4404 - DNA, 23 bp, Artificial Sequence
  Synthetic Polynucleotide
ggcccragagagtcttgcccggg

SEQ ID NO: 4405 - DNA, 23 bp, Artificial Sequence
  Synthetic Polynucleotide
gggcccragagagtcttgcccgg

SEQ ID NO: 4406 - DNA, 23 bp, Artificial Sequence
  Synthetic Polynucleotide
cccggcgccgccacygcaccacc

SEQ ID NO: 4407 - DNA, 23 bp, Artificial Sequence
  Synthetic Polynucleotide
ccccgacatctgggccygagaga

SEQ ID NO: 4408 - DNA, 23 bp, Artificial Sequence
  Synthetic Polynucleotide
cccgacatctgggccygagagag

SEQ ID NO: 4409 - DNA, 23 bp, Artificial Sequence
  Synthetic Polynucleotide
ccgacatctgggccygagagagt

SEQ ID NO: 4410 - DNA, 23 bp, Artificial Sequence
  Synthetic Polynucleotide
ccgcagrtgaggggccctggggg

SEQ ID NO: 4411 - DNA, 23 bp, Artificial Sequence
  Synthetic Polynucleotide
gccgcagrtgaggggccctgggg

SEQ ID NO: 4412 - DNA, 23 bp, Artificial Sequence
  Synthetic Polynucleotide
ggccgcagrtgaggggccctggg

SEQ ID NO: 4413 - DNA, 23 bp, Artificial Sequence
  Synthetic Polynucleotide
cctttccagtgatgaacyagtgg

SEQ ID NO: 4414 - DNA, 23 bp, Artificial Sequence
  Synthetic Polynucleotide
ctgcgrcaacaacggttttcggg

SEQ ID NO: 4415 - DNA, 23 bp, Artificial Sequence
  Synthetic Polynucleotide
gctgcgrcaacaacggttttcgg

SEQ ID NO: 4416 - DNA, 23 bp, Artificial Sequence
  Synthetic Polynucleotide
ggagacctrgaaggcctttctgg

SEQ ID NO: 4417 - DNA, 23 bp, Artificial Sequence
  Synthetic Polynucleotide
gaacgrcatgaagtactaccggg

SEQ ID NO: 4418 - DNA, 23 bp, Artificial Sequence
  Synthetic Polynucleotide
agaacgrcatgaagtactaccgg

SEQ ID NO: 4419 - DNA, 23 bp, Artificial Sequence
  Synthetic Polynucleotide
ctgcrgcaacaacggttttcggg

SEQ ID NO: 4420 - DNA, 23 bp, Artificial Sequence
  Synthetic Polynucleotide
gctgcrgcaacaacggttttcgg

SEQ ID NO: 4421 - DNA, 23 bp, Artificial Sequence
  Synthetic Polynucleotide
cctgaagattgaactcygaaaga

SEQ ID NO: 4422 - DNA, 23 bp, Artificial Sequence
  Synthetic Polynucleotide
cctttcagctgctgcaatcytag

SEQ ID NO: 4423 - DNA, 23 bp, Artificial Sequence
  Synthetic Polynucleotide
taarcatcgtggcgctggtgggg

SEQ ID NO: 4424 - DNA, 23 bp, Artificial Sequence
  Synthetic Polynucleotide
ttaarcatcgtggcgctggtggg

SEQ ID NO: 4425 - DNA, 23 bp, Artificial Sequence
  Synthetic Polynucleotide
cttaarcatcgtggcgctggtgg

SEQ ID NO: 4426 - DNA, 23 bp, Artificial Sequence
  Synthetic Polynucleotide
gctcttaarcatcgtggcgctgg

SEQ ID NO: 4427 - DNA, 23 bp, Artificial Sequence
  Synthetic Polynucleotide
ccgccaccccagctccyagttgg

SEQ ID NO: 4428 - DNA, 23 bp, Artificial Sequence
  Synthetic Polynucleotide
ccagagctccctaccyaggagga

SEQ ID NO: 4429 - DNA, 23 bp, Artificial Sequence
  Synthetic Polynucleotide
gcccrgggtctacacccgcgtgg

SEQ ID NO: 4430 - DNA, 23 bp, Artificial Sequence
  Synthetic Polynucleotide
tgtgcccratgtgcacctcccgg

SEQ ID NO: 4431 - DNA, 23 bp, Artificial Sequence
  Synthetic Polynucleotide
ccttcctttgggctggctygagg

SEQ ID NO: 4432 - DNA, 23 bp, Artificial Sequence
  Synthetic Polynucleotide
cctttgggctggctygagggaag

SEQ ID NO: 4433 - DNA, 23 bp, Artificial Sequence
  Synthetic Polynucleotide
gaaargtccacttcgtatgctgg

SEQ ID NO: 4434 - DNA, 23 bp, Artificial Sequence
  Synthetic Polynucleotide
cctggcttattatatcatytcta

SEQ ID NO: 4435 - DNA, 23 bp, Artificial Sequence
  Synthetic Polynucleotide
ccctcaaatacggagygaagcac

SEQ ID NO: 4436 - DNA, 23 bp, Artificial Sequence
  Synthetic Polynucleotide
cctcaaatacggagygaagcacg

SEQ ID NO: 4437 - DNA, 23 bp, Artificial Sequence
  Synthetic Polynucleotide
cggccrtccaggggttcagaagg

SEQ ID NO: 4438 - DNA, 23 bp, Artificial Sequence
  Synthetic Polynucleotide
caaagcgrcagccatcctggagg

SEQ ID NO: 4439 - DNA, 23 bp, Artificial Sequence
  Synthetic Polynucleotide
gtgtgrtcacctctggcggcggg

SEQ ID NO: 4440 - DNA, 23 bp, Artificial Sequence
  Synthetic Polynucleotide
ggtgtgrtcacctctggcggcgg

SEQ ID NO: 4441 - DNA, 23 bp, Artificial Sequence
  Synthetic Polynucleotide
gcgagrgagatgagagacggcgg

SEQ ID NO: 4442 - DNA, 23 bp, Artificial Sequence
  Synthetic Polynucleotide
caggcgagrgagatgagagacgg

SEQ ID NO: 4443 - DNA, 23 bp, Artificial Sequence
  Synthetic Polynucleotide
gtttgtgrtctgccagctaaagg

SEQ ID NO: 4444 - DNA, 23 bp, Artificial Sequence
  Synthetic Polynucleotide
tatrtgcatatttattacatcgg

SEQ ID NO: 4445 - DNA, 23 bp, Artificial Sequence
  Synthetic Polynucleotide
aaagctrgaaagggacgaactgg

SEQ ID NO: 4446 - DNA, 23 bp, Artificial Sequence
  Synthetic Polynucleotide
accrccaaatttaattgcagagg

SEQ ID NO: 4447 - DNA, 23 bp, Artificial Sequence
  Synthetic Polynucleotide
ccttttgaagaccataaccyacc

SEQ ID NO: 4448 - DNA, 23 bp, Artificial Sequence
  Synthetic Polynucleotide
ccaattcaggacccacaygacgg

SEQ ID NO: 4449 - DNA, 23 bp, Artificial Sequence
  Synthetic Polynucleotide
cccactggcagcaggtacygagg

SEQ ID NO: 4450 - DNA, 23 bp, Artificial Sequence
  Synthetic Polynucleotide
ccactggcagcaggtacygaggt

SEQ ID NO: 4451 - DNA, 23 bp, Artificial Sequence
  Synthetic Polynucleotide
ccatccagatggtgyggtctcag

SEQ ID NO: 4452 - DNA, 23 bp, Artificial Sequence
  Synthetic Polynucleotide
cccagtttctgatctcygtgttg

SEQ ID NO: 4453 - DNA, 23 bp, Artificial Sequence
  Synthetic Polynucleotide
ccagtttctgatctcygtgttgc

SEQ ID NO: 4454 - DNA, 23 bp, Artificial Sequence
  Synthetic Polynucleotide
agccaccrattgtacaggtaggg

SEQ ID NO: 4455 - DNA, 23 bp, Artificial Sequence
  Synthetic Polynucleotide
gagccaccrattgtacaggtagg

SEQ ID NO: 4456 - DNA, 23 bp, Artificial Sequence
  Synthetic Polynucleotide
ccaggcacaagtgtccygccgca

SEQ ID NO: 4457 - DNA, 23 bp, Artificial Sequence
  Synthetic Polynucleotide
ccgtcaccatgaagyacaaggtc

SEQ ID NO: 4458 - DNA, 23 bp, Artificial Sequence
  Synthetic Polynucleotide
cctgggctccacgcagggcyaga

SEQ ID NO: 4459 - DNA, 23 bp, Artificial Sequence
  Synthetic Polynucleotide
ccttccagcgctgcgccyggaca

SEQ ID NO: 4460 - DNA, 23 bp, Artificial Sequence
  Synthetic Polynucleotide
tcctrggaaactcggttaaaagg

SEQ ID NO: 4461 - DNA, 23 bp, Artificial Sequence
  Synthetic Polynucleotide
cccagcgtgacctgggacaygga

SEQ ID NO: 4462 - DNA, 23 bp, Artificial Sequence
  Synthetic Polynucleotide
ccagcgtgacctgggacayggag

SEQ ID NO: 4463 - DNA, 23 bp, Artificial Sequence
  Synthetic Polynucleotide
agcrcacgaagaacatgcagcgg

SEQ ID NO: 4464 - DNA, 23 bp, Artificial Sequence
  Synthetic Polynucleotide
ggcaccraagcctcggggacagg

SEQ ID NO: 4465 - DNA, 23 bp, Artificial Sequence
  Synthetic Polynucleotide
ctcrtggggtggccacattgcgg

SEQ ID NO: 4466 - DNA, 23 bp, Artificial Sequence
  Synthetic Polynucleotide
ccaatggtcagagcccygttgag

SEQ ID NO: 4467 - DNA, 23 bp, Artificial Sequence
  Synthetic Polynucleotide
cctgtgtgtccacccayttggca

SEQ ID NO: 4468 - DNA, 23 bp, Artificial Sequence
  Synthetic Polynucleotide
tctggrttctcgatgcgtgcagg

SEQ ID NO: 4469 - DNA, 23 bp, Artificial Sequence
  Synthetic Polynucleotide
cccggactgcgctcccayctgaa

SEQ ID NO: 4470 - DNA, 23 bp, Artificial Sequence
  Synthetic Polynucleotide
ccggactgcgctcccayctgaac

SEQ ID NO: 4471 - DNA, 23 bp, Artificial Sequence
  Synthetic Polynucleotide
cgcrgtacccttagagacagagg

SEQ ID NO: 4472 - DNA, 23 bp, Artificial Sequence
  Synthetic Polynucleotide
tgtcrtacagaaataaaatttgg

SEQ ID NO: 4473 - DNA, 23 bp, Artificial Sequence
  Synthetic Polynucleotide
ccctgctgtgtgctycacacttc

SEQ ID NO: 4474 - DNA, 23 bp, Artificial Sequence
  Synthetic Polynucleotide
gtggracactgctgggcaggagg

SEQ ID NO: 4475 - DNA, 23 bp, Artificial Sequence
  Synthetic Polynucleotide
gctgtggracactgctgggcagg

SEQ ID NO: 4476 - DNA, 23 bp, Artificial Sequence
  Synthetic Polynucleotide
attgaccrgggtggaggtgaagg

SEQ ID NO: 4477 - DNA, 23 bp, Artificial Sequence
  Synthetic Polynucleotide
cttcrtactcggttattaaatgg

SEQ ID NO: 4478 - DNA, 23 bp, Artificial Sequence
  Synthetic Polynucleotide
gttccrctatgattcagctttgg

SEQ ID NO: 4479 - DNA, 23 bp, Artificial Sequence
  Synthetic Polynucleotide
ccattgcaaagaggttcygctat

SEQ ID NO: 4480 - DNA, 23 bp, Artificial Sequence
  Synthetic Polynucleotide
cctttgcatgcccttyggaatgc

SEQ ID NO: 4481 - DNA, 23 bp, Artificial Sequence
  Synthetic Polynucleotide
gtattactrcaatgagcatgtgg

SEQ ID NO: 4482 - DNA, 23 bp, Artificial Sequence
  Synthetic Polynucleotide
tgagtgcarcaaggaggctccgg

SEQ ID NO: 4483 - DNA, 23 bp, Artificial Sequence
  Synthetic Polynucleotide
cccaggtrgggattgcaccctgg

SEQ ID NO: 4484 - DNA, 23 bp, Artificial Sequence
  Synthetic Polynucleotide
ccatgctcgagtgcygcgtgtgc

SEQ ID NO: 4485 - DNA, 23 bp, Artificial Sequence
  Synthetic Polynucleotide
gtggcrgcggcaggagaagctgg

SEQ ID NO: 4486 - DNA, 23 bp, Artificial Sequence
  Synthetic Polynucleotide
gagcrgctggagtcaggctcggg

SEQ ID NO: 4487 - DNA, 23 bp, Artificial Sequence
  Synthetic Polynucleotide
ggagcrgctggagtcaggctcgg

SEQ ID NO: 4488 - DNA, 23 bp, Artificial Sequence
  Synthetic Polynucleotide
gacaraatcttagtatcaattgg

SEQ ID NO: 4489 - DNA, 23 bp, Artificial Sequence
  Synthetic Polynucleotide
cctcgaacacccaggygaggtca

SEQ ID NO: 4490 - DNA, 23 bp, Artificial Sequence
  Synthetic Polynucleotide
cctgaggaggacccagagyagga

SEQ ID NO: 4491 - DNA, 23 bp, Artificial Sequence
  Synthetic Polynucleotide
ccaatacctcacattcctygaag

SEQ ID NO: 4492 - DNA, 23 bp, Artificial Sequence
  Synthetic Polynucleotide
ccaggaacccggacgggggyagc

SEQ ID NO: 4493 - DNA, 23 bp, Artificial Sequence
  Synthetic Polynucleotide
ggcccagtrggccatctcacagg

SEQ ID NO: 4494 - DNA, 23 bp, Artificial Sequence
  Synthetic Polynucleotide
aaggccgcrgtctcgtagtccgg

SEQ ID NO: 4495 - DNA, 23 bp, Artificial Sequence
  Synthetic Polynucleotide
ggtctcrtagtccggtgagccgg

SEQ ID NO: 4496 - DNA, 23 bp, Artificial Sequence
  Synthetic Polynucleotide
ccgcggtctcgtagtcyggtgag

SEQ ID NO: 4497 - DNA, 23 bp, Artificial Sequence
  Synthetic Polynucleotide
ccactgacctcatgtygatgatc

SEQ ID NO: 4498 - DNA, 23 bp, Artificial Sequence
  Synthetic Polynucleotide
ctcagrtgagcactgggatgggg

SEQ ID NO: 4499 - DNA, 23 bp, Artificial Sequence
  Synthetic Polynucleotide
cctcagrtgagcactgggatggg

SEQ ID NO: 4500 - DNA, 23 bp, Artificial Sequence
  Synthetic Polynucleotide
tcctcagrtgagcactgggatgg

SEQ ID NO: 4501 - DNA, 23 bp, Artificial Sequence
  Synthetic Polynucleotide
caagrtaagtctggagaaagagg

SEQ ID NO: 4502 - DNA, 23 bp, Artificial Sequence
  Synthetic Polynucleotide
cccttccacgacctcyagagcga

SEQ ID NO: 4503 - DNA, 23 bp, Artificial Sequence
  Synthetic Polynucleotide
ccttccacgacctcyagagcgag

SEQ ID NO: 4504 - DNA, 23 bp, Artificial Sequence
  Synthetic Polynucleotide
ccagagagctcgctagcygaggt

SEQ ID NO: 4505 - DNA, 23 bp, Artificial Sequence
  Synthetic Polynucleotide
ccacttcctcctcayctacctgc

SEQ ID NO: 4506 - DNA, 23 bp, Artificial Sequence
  Synthetic Polynucleotide
cctcagccggcgtctytgcagac

SEQ ID NO: 4507 - DNA, 23 bp, Artificial Sequence
  Synthetic Polynucleotide
cctgcagggcgaagacctgygag

SEQ ID NO: 4508 - DNA, 23 bp, Artificial Sequence
  Synthetic Polynucleotide
cccatgaggcccccaycttctgc

SEQ ID NO: 4509 - DNA, 23 bp, Artificial Sequence
  Synthetic Polynucleotide
ccatgaggcccccaycttctgca

SEQ ID NO: 4510 - DNA, 23 bp, Artificial Sequence
  Synthetic Polynucleotide
ccgggaacggcggcgggtayagc

SEQ ID NO: 4511 - DNA, 23 bp, Artificial Sequence
  Synthetic Polynucleotide
cctgggggccaccttcatcygaa

SEQ ID NO: 4512 - DNA, 23 bp, Artificial Sequence
  Synthetic Polynucleotide
ccgagaaagcctgaaggaaygag

SEQ ID NO: 4513 - DNA, 23 bp, Artificial Sequence
  Synthetic Polynucleotide
cctggccagagaggccttcygca

SEQ ID NO: 4514 - DNA, 23 bp, Artificial Sequence
  Synthetic Polynucleotide
ccagagaggccttcygcagagca

SEQ ID NO: 4515 - DNA, 23 bp, Artificial Sequence
  Synthetic Polynucleotide
gctcraaggcttggtggccgggg

SEQ ID NO: 4516 - DNA, 23 bp, Artificial Sequence
  Synthetic Polynucleotide
agctcraaggcttggtggccggg

SEQ ID NO: 4517 - DNA, 23 bp, Artificial Sequence
  Synthetic Polynucleotide
aagctcraaggcttggtggccgg

SEQ ID NO: 4518 - DNA, 23 bp, Artificial Sequence
  Synthetic Polynucleotide
acaaggcrgcttggaacaagagg

SEQ ID NO: 4519 - DNA, 23 bp, Artificial Sequence
  Synthetic Polynucleotide
cttgctgraggagttgctgtggg

SEQ ID NO: 4520 - DNA, 23 bp, Artificial Sequence
  Synthetic Polynucleotide
ccttgctgraggagttgctgtgg

SEQ ID NO: 4521 - DNA, 23 bp, Artificial Sequence
  Synthetic Polynucleotide
cccttccagattgtggatcygct

SEQ ID NO: 4522 - DNA, 23 bp, Artificial Sequence
  Synthetic Polynucleotide
ccttccagattgtggatcygctg

SEQ ID NO: 4523 - DNA, 23 bp, Artificial Sequence
  Synthetic Polynucleotide
ccagattgtggatcygctggccc

SEQ ID NO: 4524 - DNA, 23 bp, Artificial Sequence
  Synthetic Polynucleotide
gagrgcctgcagtgctcgtgtgg

SEQ ID NO: 4525 - DNA, 23 bp, Artificial Sequence
  Synthetic Polynucleotide
tcgccrgctggtccaggtaatgg

SEQ ID NO: 4526 - DNA, 23 bp, Artificial Sequence
  Synthetic Polynucleotide
cccttctccaatgcgaygggtgt

SEQ ID NO: 4527 - DNA, 23 bp, Artificial Sequence
  Synthetic Polynucleotide
ccttctccaatgcgaygggtgtg

SEQ ID NO: 4528 - DNA, 23 bp, Artificial Sequence
  Synthetic Polynucleotide
ccaagacggagacgagcyaggtg

SEQ ID NO: 4529 - DNA, 23 bp, Artificial Sequence
  Synthetic Polynucleotide
cctgatctgctgggtgcyctacg

SEQ ID NO: 4530 - DNA, 23 bp, Artificial Sequence
  Synthetic Polynucleotide
cctgcgccgcacccycactcgcc

SEQ ID NO: 4531 - DNA, 23 bp, Artificial Sequence
  Synthetic Polynucleotide
gcgrgcaggggccccgtgctggg

SEQ ID NO: 4532 - DNA, 23 bp, Artificial Sequence
  Synthetic Polynucleotide
ggcgrgcaggggccccgtgctgg

SEQ ID NO: 4533 - DNA, 23 bp, Artificial Sequence
  Synthetic Polynucleotide
tgtccrgttcagctggcgcacgg

SEQ ID NO: 4534 - DNA, 23 bp, Artificial Sequence
  Synthetic Polynucleotide
cccgcggtgtgccgyaaggagcc

SEQ ID NO: 4535 - DNA, 23 bp, Artificial Sequence
  Synthetic Polynucleotide
gtgaaatragggcacatattcgg

SEQ ID NO: 4536 - DNA, 23 bp, Artificial Sequence
  Synthetic Polynucleotide
ccagttctgtccactttgcygtt

SEQ ID NO: 4537 - DNA, 23 bp, Artificial Sequence
  Synthetic Polynucleotide
accrcccacaaccctatcgctgg

SEQ ID NO: 4538 - DNA, 23 bp, Artificial Sequence
  Synthetic Polynucleotide
ccttttctggatgtttygcatca

SEQ ID NO: 4539 - DNA, 23 bp, Artificial Sequence
  Synthetic Polynucleotide
cccccagtggccccccayaggga

SEQ ID NO: 4540 - DNA, 23 bp, Artificial Sequence
  Synthetic Polynucleotide
ccccagtggccccccayagggag

SEQ ID NO: 4541 - DNA, 23 bp, Artificial Sequence
  Synthetic Polynucleotide
cccagtggccccccayagggagt

SEQ ID NO: 4542 - DNA, 23 bp, Artificial Sequence
  Synthetic Polynucleotide
ccagtggccccccayagggagtg

SEQ ID NO: 4543 - DNA, 23 bp, Artificial Sequence
  Synthetic Polynucleotide
ccccgggggagcagaccyaggct

SEQ ID NO: 4544 - DNA, 23 bp, Artificial Sequence
  Synthetic Polynucleotide
cccgggggagcagaccyaggctg

SEQ ID NO: 4545 - DNA, 23 bp, Artificial Sequence
  Synthetic Polynucleotide
ccgggggagcagaccyaggctgt

SEQ ID NO: 4546 - DNA, 23 bp, Artificial Sequence
  Synthetic Polynucleotide
ccggggaattgcctgtgcaygct

SEQ ID NO: 4547 - DNA, 23 bp, Artificial Sequence
  Synthetic Polynucleotide
ccacaccgcagcggygacagctg

SEQ ID NO: 4548 - DNA, 23 bp, Artificial Sequence
  Synthetic Polynucleotide
ccaacaatttcgtgtgygagatt

SEQ ID NO: 4549 - DNA, 23 bp, Artificial Sequence
  Synthetic Polynucleotide
accrgcagtctccttcgatgtgg

SEQ ID NO: 4550 - DNA, 23 bp, Artificial Sequence
  Synthetic Polynucleotide
ccgcactgatgcttacgtayggg

SEQ ID NO: 4551 - DNA, 23 bp, Artificial Sequence
  Synthetic Polynucleotide
cctgggcaatcacagaacayccc

SEQ ID NO: 4552 - DNA, 23 bp, Artificial Sequence
  Synthetic Polynucleotide
cccttgaggtccacyaggcttat

SEQ ID NO: 4553 - DNA, 23 bp, Artificial Sequence
  Synthetic Polynucleotide
ccctgtcctccgcaggyccgcca

SEQ ID NO: 4554 - DNA, 23 bp, Artificial Sequence
  Synthetic Polynucleotide
cctgtcctccgcaggyccgccag

SEQ ID NO: 4555 - DNA, 23 bp, Artificial Sequence
  Synthetic Polynucleotide
tatatgcraatctataagaaagg

SEQ ID NO: 4556 - DNA, 23 bp, Artificial Sequence
  Synthetic Polynucleotide
acctcaggracaaagagatctgg

SEQ ID NO: 4557 - DNA, 23 bp, Artificial Sequence
  Synthetic Polynucleotide
cccccagcttccacagcgyggca

SEQ ID NO: 4558 - DNA, 23 bp, Artificial Sequence
  Synthetic Polynucleotide
ccccagcttccacagcgyggcac

SEQ ID NO: 4559 - DNA, 23 bp, Artificial Sequence
  Synthetic Polynucleotide
cccagcttccacagcgyggcacc

SEQ ID NO: 4560 - DNA, 23 bp, Artificial Sequence
  Synthetic Polynucleotide
ccagcttccacagcgyggcacct

SEQ ID NO: 4561 - DNA, 23 bp, Artificial Sequence
  Synthetic Polynucleotide
cccagccacttcagcygaggctc

SEQ ID NO: 4562 - DNA, 23 bp, Artificial Sequence
  Synthetic Polynucleotide
ccagccacttcagcygaggctcc

SEQ ID NO: 4563 - DNA, 23 bp, Artificial Sequence
  Synthetic Polynucleotide
agatgrtgagtcttcttgcgtgg

SEQ ID NO: 4564 - DNA, 23 bp, Artificial Sequence
  Synthetic Polynucleotide
ccaactgccacaatacyaactaa

SEQ ID NO: 4565 - DNA, 23 bp, Artificial Sequence
  Synthetic Polynucleotide
aagrtaagctggcgctccctcgg

SEQ ID NO: 4566 - DNA, 23 bp, Artificial Sequence
  Synthetic Polynucleotide
cccttgatgtcctgyaaatgaag

SEQ ID NO: 4567 - DNA, 23 bp, Artificial Sequence
  Synthetic Polynucleotide
accrgcgagaactctttcttagg

SEQ ID NO: 4568 - DNA, 23 bp, Artificial Sequence
  Synthetic Polynucleotide
ggtggagcrctttagtcaggagg

SEQ ID NO: 4569 - DNA, 23 bp, Artificial Sequence
  Synthetic Polynucleotide
cctgagaagaaaactcyttctac

SEQ ID NO: 4570 - DNA, 23 bp, Artificial Sequence
  Synthetic Polynucleotide
cctggcataagacctytcttctt

SEQ ID NO: 4571 - DNA, 23 bp, Artificial Sequence
  Synthetic Polynucleotide
ccacagcccgggggtgcccyaca

SEQ ID NO: 4572 - DNA, 23 bp, Artificial Sequence
  Synthetic Polynucleotide
ccgcaggtcatttgccyactctc

SEQ ID NO: 4573 - DNA, 23 bp, Artificial Sequence
  Synthetic Polynucleotide
cctttcaacagtctyagcaaccc

SEQ ID NO: 4574 - DNA, 23 bp, Artificial Sequence
  Synthetic Polynucleotide
cctcgcggcaccacctyagtcgg

SEQ ID NO: 4575 - DNA, 23 bp, Artificial Sequence
  Synthetic Polynucleotide
gactrtccccctgggtacttcgg

SEQ ID NO: 4576 - DNA, 23 bp, Artificial Sequence
  Synthetic Polynucleotide
ccgccgggaaggcatcygccagt

SEQ ID NO: 4577 - DNA, 23 bp, Artificial Sequence
  Synthetic Polynucleotide
ccgcttctccaacccaygaatgc

SEQ ID NO: 4578 - DNA, 23 bp, Artificial Sequence
  Synthetic Polynucleotide
agaacrccaatgtggtggtgcgg

SEQ ID NO: 4579 - DNA, 23 bp, Artificial Sequence
  Synthetic Polynucleotide
gaccrtgggccttctggcggtgg

SEQ ID NO: 4580 - DNA, 23 bp, Artificial Sequence
  Synthetic Polynucleotide
gatgaccrtgggccttctggcgg

SEQ ID NO: 4581 - DNA, 23 bp, Artificial Sequence
  Synthetic Polynucleotide
gtgrgagatgccccaggtcaggg

SEQ ID NO: 4582 - DNA, 23 bp, Artificial Sequence
  Synthetic Polynucleotide
agtgrgagatgccccaggtcagg

SEQ ID NO: 4583 - DNA, 23 bp, Artificial Sequence
  Synthetic Polynucleotide
cctccrctcccttgtgcccttgg

SEQ ID NO: 4584 - DNA, 23 bp, Artificial Sequence
  Synthetic Polynucleotide
aggcattgrggacgagatcgagg

SEQ ID NO: 4585 - DNA, 23 bp, Artificial Sequence
  Synthetic Polynucleotide
gttacaargcacgcgggttgggg

SEQ ID NO: 4586 - DNA, 23 bp, Artificial Sequence
  Synthetic Polynucleotide
ggttacaargcacgcgggttggg

SEQ ID NO: 4587 - DNA, 23 bp, Artificial Sequence
  Synthetic Polynucleotide
ggtcrtctacctgtacaccgtgg

SEQ ID NO: 4588 - DNA, 23 bp, Artificial Sequence
  Synthetic Polynucleotide
cctgccgcagccgccgctycatg

SEQ ID NO: 4589 - DNA, 23 bp, Artificial Sequence
  Synthetic Polynucleotide
ccgcagccgccgctycatgctct

SEQ ID NO: 4590 - DNA, 23 bp, Artificial Sequence
  Synthetic Polynucleotide
ccagcagagcctggcgyacagtc

SEQ ID NO: 4591 - DNA, 23 bp, Artificial Sequence
  Synthetic Polynucleotide
ccctcagtgttacctgtttyaca

SEQ ID NO: 4592 - DNA, 23 bp, Artificial Sequence
  Synthetic Polynucleotide
cctcagtgttacctgtttyacat

SEQ ID NO: 4593 - DNA, 23 bp, Artificial Sequence
  Synthetic Polynucleotide
cctgaatatgtgtgcgyccaccg

SEQ ID NO: 4594 - DNA, 23 bp, Artificial Sequence
  Synthetic Polynucleotide
ccatgccatcctgctcyggcatg

SEQ ID NO: 4595 - DNA, 23 bp, Artificial Sequence
  Synthetic Polynucleotide
ccttcaacttcttcygcaagttc

SEQ ID NO: 4596 - DNA, 23 bp, Artificial Sequence
  Synthetic Polynucleotide
ccacccccacgctgcccygactc

SEQ ID NO: 4597 - DNA, 23 bp, Artificial Sequence
  Synthetic Polynucleotide
cccccacgctgcccygactccct

SEQ ID NO: 4598 - DNA, 23 bp, Artificial Sequence
  Synthetic Polynucleotide
cctggaggaaagcayaggctaca

SEQ ID NO: 4599 - DNA, 23 bp, Artificial Sequence
  Synthetic Polynucleotide
ccgactggtgctcaacaygccgt

SEQ ID NO: 4600 - DNA, 23 bp, Artificial Sequence
  Synthetic Polynucleotide
tcattgrtggtgatgtcctcagg

SEQ ID NO: 4601 - DNA, 23 bp, Artificial Sequence
  Synthetic Polynucleotide
ttcrtgctggaggagggatcggg

SEQ ID NO: 4602 - DNA, 23 bp, Artificial Sequence
  Synthetic Polynucleotide
gttcrtgctggaggagggatcgg

SEQ ID NO: 4603 - DNA, 23 bp, Artificial Sequence
  Synthetic Polynucleotide
ccacatggggaacgygatcatga

SEQ ID NO: 4604 - DNA, 23 bp, Artificial Sequence
  Synthetic Polynucleotide
ccctcagaactattttgctygca

SEQ ID NO: 4605 - DNA, 23 bp, Artificial Sequence
  Synthetic Polynucleotide
cctcagaactattttgctygcaa

SEQ ID NO: 4606 - DNA, 23 bp, Artificial Sequence
  Synthetic Polynucleotide
cccagcatgaagaatcaygcaca

SEQ ID NO: 4607 - DNA, 23 bp, Artificial Sequence
  Synthetic Polynucleotide
ccagcatgaagaatcaygcacag

SEQ ID NO: 4608 - DNA, 23 bp, Artificial Sequence
  Synthetic Polynucleotide
ccatgrtgcggaggactcgctgg

SEQ ID NO: 4609 - DNA, 23 bp, Artificial Sequence
  Synthetic Polynucleotide
gaacraatggatttgttatctgg

SEQ ID NO: 4610 - DNA, 23 bp, Artificial Sequence
  Synthetic Polynucleotide
cctgctttgaaaagcttyaaaca

SEQ ID NO: 4611 - DNA, 23 bp, Artificial Sequence
  Synthetic Polynucleotide
cccacaggagctccgtgygatta

SEQ ID NO: 4612 - DNA, 23 bp, Artificial Sequence
  Synthetic Polynucleotide
ccacaggagctccgtgygattac

SEQ ID NO: 4613 - DNA, 23 bp, Artificial Sequence
  Synthetic Polynucleotide
cccccaatccagctacctyagag

SEQ ID NO: 4614 - DNA, 23 bp, Artificial Sequence
  Synthetic Polynucleotide
ccccaatccagctacctyagagc

SEQ ID NO: 4615 - DNA, 23 bp, Artificial Sequence
  Synthetic Polynucleotide
cccaatccagctacctyagagca

SEQ ID NO: 4616 - DNA, 23 bp, Artificial Sequence
  Synthetic Polynucleotide
ccaatccagctacctyagagcag

SEQ ID NO: 4617 - DNA, 23 bp, Artificial Sequence
  Synthetic Polynucleotide
cccagctgtttgatgtatygaag

SEQ ID NO: 4618 - DNA, 23 bp, Artificial Sequence
  Synthetic Polynucleotide
ccagctgtttgatgtatygaaga

SEQ ID NO: 4619 - DNA, 23 bp, Artificial Sequence
  Synthetic Polynucleotide
ccaggagcttcacacaatygatt

SEQ ID NO: 4620 - DNA, 23 bp, Artificial Sequence
  Synthetic Polynucleotide
cctcaatttcaacgtcttygata

SEQ ID NO: 4621 - DNA, 23 bp, Artificial Sequence
  Synthetic Polynucleotide
ccagagaaatttgcagagyagct

SEQ ID NO: 4622 - DNA, 23 bp, Artificial Sequence
  Synthetic Polynucleotide
ttggtctcrttcaaaaacatagg

SEQ ID NO: 4623 - DNA, 23 bp, Artificial Sequence
  Synthetic Polynucleotide
ggcacgtrtgcctgcgagccggg

SEQ ID NO: 4624 - DNA, 23 bp, Artificial Sequence
  Synthetic Polynucleotide
cggcacgtrtgcctgcgagccgg

SEQ ID NO: 4625 - DNA, 23 bp, Artificial Sequence
  Synthetic Polynucleotide
aacacacrgaaggtacgcagggg

SEQ ID NO: 4626 - DNA, 23 bp, Artificial Sequence
  Synthetic Polynucleotide
gaacacacrgaaggtacgcaggg

SEQ ID NO: 4627 - DNA, 23 bp, Artificial Sequence
  Synthetic Polynucleotide
tgggactrtatggaggttgctgg

SEQ ID NO: 4628 - DNA, 23 bp, Artificial Sequence
  Synthetic Polynucleotide
aacargatatcattatttcctgg

SEQ ID NO: 4629 - DNA, 23 bp, Artificial Sequence
  Synthetic Polynucleotide
catgrtgattggaaacctagtgg

SEQ ID NO: 4630 - DNA, 23 bp, Artificial Sequence
  Synthetic Polynucleotide
ctggraaaatctttatcaactgg

SEQ ID NO: 4631 - DNA, 23 bp, Artificial Sequence
  Synthetic Polynucleotide
cttgtttcractaatgactcagg

SEQ ID NO: 4632 - DNA, 23 bp, Artificial Sequence
  Synthetic Polynucleotide
tccvcgtgctgtgtggggagtgg

SEQ ID NO: 4633 - DNA, 23 bp, Artificial Sequence
  Synthetic Polynucleotide
tgtgttccvcgtgctgtgtgggg

SEQ ID NO: 4634 - DNA, 23 bp, Artificial Sequence
  Synthetic Polynucleotide
tgttctccrttcatttcgattgg

SEQ ID NO: 4635 - DNA, 23 bp, Artificial Sequence
  Synthetic Polynucleotide
cctggattcttcaagtthtagat

SEQ ID NO: 4636 - DNA, 23 bp, Artificial Sequence
  Synthetic Polynucleotide
ccttttcagctttagagggygag

SEQ ID NO: 4637 - DNA, 23 bp, Artificial Sequence
  Synthetic Polynucleotide
cctggttgtgatggaccyatttg

SEQ ID NO: 4638 - DNA, 23 bp, Artificial Sequence
  Synthetic Polynucleotide
ccttgtttgtgcccygacgacac

SEQ ID NO: 4639 - DNA, 23 bp, Artificial Sequence
  Synthetic Polynucleotide
ccatcttccggttcagtgycacc

SEQ ID NO: 4640 - DNA, 23 bp, Artificial Sequence
  Synthetic Polynucleotide
ccggttcagtgccayctctgccc

SEQ ID NO: 4641 - DNA, 23 bp, Artificial Sequence
  Synthetic Polynucleotide
ccgagcattgaagabgatttcag

SEQ ID NO: 4642 - DNA, 23 bp, Artificial Sequence
  Synthetic Polynucleotide
ccttcccaaaggcaaygagcaat

SEQ ID NO: 4643 - DNA, 23 bp, Artificial Sequence
  Synthetic Polynucleotide
ccttggttggtggacyttcagtt

SEQ ID NO: 4644 - DNA, 23 bp, Artificial Sequence
  Synthetic Polynucleotide
ccctgcarccaacagagacatgg

SEQ ID NO: 4645 - DNA, 23 bp, Artificial Sequence
  Synthetic Polynucleotide
ggaggtgractcggagaccgagg

SEQ ID NO: 4646 - DNA, 23 bp, Artificial Sequence
  Synthetic Polynucleotide
tgagcrcttcgagggccgcgtgg

SEQ ID NO: 4647 - DNA, 23 bp, Artificial Sequence
  Synthetic Polynucleotide
ttccrgctggtaaattaactggg

SEQ ID NO: 4648 - DNA, 23 bp, Artificial Sequence
  Synthetic Polynucleotide
attccrgctggtaaattaactgg

SEQ ID NO: 4649 - DNA, 23 bp, Artificial Sequence
  Synthetic Polynucleotide
catcrtcttcatttttgctgtgg

SEQ ID NO: 4650 - DNA, 23 bp, Artificial Sequence
  Synthetic Polynucleotide
gtcccrgtttgaaggaatgaggg

SEQ ID NO: 4651 - DNA, 23 bp, Artificial Sequence
  Synthetic Polynucleotide
tgtcccrgtttgaaggaatgagg

SEQ ID NO: 4652 - DNA, 23 bp, Artificial Sequence
  Synthetic Polynucleotide
ccttcctgatcgtgttcygcgtg

SEQ ID NO: 4653 - DNA, 23 bp, Artificial Sequence
  Synthetic Polynucleotide
ccaggttgttgtaaatgctyttt

SEQ ID NO: 4654 - DNA, 23 bp, Artificial Sequence
  Synthetic Polynucleotide
ccaggggaaacaatytattgaag

SEQ ID NO: 4655 - DNA, 23 bp, Artificial Sequence
  Synthetic Polynucleotide
tccrtgtgatccgcctggcgcgg

SEQ ID NO: 4656 - DNA, 23 bp, Artificial Sequence
  Synthetic Polynucleotide
gctgttccrtgtgatccgcctgg

SEQ ID NO: 4657 - DNA, 23 bp, Artificial Sequence
  Synthetic Polynucleotide
gcagctgcrggtcttcaagctgg

SEQ ID NO: 4658 - DNA, 23 bp, Artificial Sequence
  Synthetic Polynucleotide
tgcrggccctgcgtcccctgagg

SEQ ID NO: 4659 - DNA, 23 bp, Artificial Sequence
  Synthetic Polynucleotide
tgtgctacrctccttccgtctgg

SEQ ID NO: 4660 - DNA, 23 bp, Artificial Sequence
  Synthetic Polynucleotide
cagcacccrgaaggtcctcaggg

SEQ ID NO: 4661 - DNA, 23 bp, Artificial Sequence
  Synthetic Polynucleotide
ccctcctaggcgccatcycctcc

SEQ ID NO: 4662 - DNA, 23 bp, Artificial Sequence
  Synthetic Polynucleotide
cctcctaggcgccatcycctcca

SEQ ID NO: 4663 - DNA, 23 bp, Artificial Sequence
  Synthetic Polynucleotide
cactcaraccacgccatcggagg

SEQ ID NO: 4664 - DNA, 23 bp, Artificial Sequence
  Synthetic Polynucleotide
ctgrgagcgcctctatcagcagg

SEQ ID NO: 4665 - DNA, 23 bp, Artificial Sequence
  Synthetic Polynucleotide
cgtgartgtgggcacccgaaggg

SEQ ID NO: 4666 - DNA, 23 bp, Artificial Sequence
  Synthetic Polynucleotide
acgtgartgtgggcacccgaagg

SEQ ID NO: 4667 - DNA, 23 bp, Artificial Sequence
  Synthetic Polynucleotide
gagccragaggggctgcccgagg

SEQ ID NO: 4668 - DNA, 23 bp, Artificial Sequence
  Synthetic Polynucleotide
tgcccraggaggaggctccccgg

SEQ ID NO: 4669 - DNA, 23 bp, Artificial Sequence
  Synthetic Polynucleotide
caacrgcaccaacggctccgtgg

SEQ ID NO: 4670 - DNA, 23 bp, Artificial Sequence
  Synthetic Polynucleotide
aacrgctccgtggaggccgacgg

SEQ ID NO: 4671 - DNA, 23 bp, Artificial Sequence
  Synthetic Polynucleotide
ctccrtggaggccgacggcttgg

SEQ ID NO: 4672 - DNA, 23 bp, Artificial Sequence
  Synthetic Polynucleotide
cggcttgrtctgggaatccctgg

SEQ ID NO: 4673 - DNA, 23 bp, Artificial Sequence
  Synthetic Polynucleotide
ctgggagcrcctctatcagcagg

SEQ ID NO: 4674 - DNA, 23 bp, Artificial Sequence
  Synthetic Polynucleotide
cgtggtcrcaatggcctatgagg

SEQ ID NO: 4675 - DNA, 23 bp, Artificial Sequence
  Synthetic Polynucleotide
gcttcraggagccaggagcacgg

SEQ ID NO: 4676 - DNA, 23 bp, Artificial Sequence
  Synthetic Polynucleotide
catcrtcatccttagcctcatgg

SEQ ID NO: 4677 - DNA, 23 bp, Artificial Sequence
  Synthetic Polynucleotide
tccdcatcctctgtggagagtgg

SEQ ID NO: 4678 - DNA, 23 bp, Artificial Sequence
  Synthetic Polynucleotide
aggccractggcggcagcagtgg

SEQ ID NO: 4679 - DNA, 23 bp, Artificial Sequence
  Synthetic Polynucleotide
agaggagcrgaagaccatcaagg

SEQ ID NO: 4680 - DNA, 23 bp, Artificial Sequence
  Synthetic Polynucleotide
tgggcrtgaacctctttgcgggg

SEQ ID NO: 4681 - DNA, 23 bp, Artificial Sequence
  Synthetic Polynucleotide
atgggcrtgaacctctttgcggg

SEQ ID NO: 4682 - DNA, 23 bp, Artificial Sequence
  Synthetic Polynucleotide
catgggcrtgaacctctttgcgg

SEQ ID NO: 4683 - DNA, 23 bp, Artificial Sequence
  Synthetic Polynucleotide
cttcrcttatgtcaagtgggagg

SEQ ID NO: 4684 - DNA, 23 bp, Artificial Sequence
  Synthetic Polynucleotide
caacttcrcttatgtcaagtggg

SEQ ID NO: 4685 - DNA, 23 bp, Artificial Sequence
  Synthetic Polynucleotide
ccaacttcrcttatgtcaagtgg

SEQ ID NO: 4686 - DNA, 23 bp, Artificial Sequence
  Synthetic Polynucleotide
ctcatcrtagacgtgagtgtggg

SEQ ID NO: 4687 - DNA, 23 bp, Artificial Sequence
  Synthetic Polynucleotide
cctcatcrtagacgtgagtgtgg

SEQ ID NO: 4688 - DNA, 23 bp, Artificial Sequence
  Synthetic Polynucleotide
ccgcrgctcaaccaccttgcagg

SEQ ID NO: 4689 - DNA, 23 bp, Artificial Sequence
  Synthetic Polynucleotide
ctccttgragatgtcccctttgg

SEQ ID NO: 4690 - DNA, 23 bp, Artificial Sequence
  Synthetic Polynucleotide
ttcraggagatgctgcaggtcgg

SEQ ID NO: 4691 - DNA, 23 bp, Artificial Sequence
  Synthetic Polynucleotide
tgaattcraggagatgctgcagg

SEQ ID NO: 4692 - DNA, 23 bp, Artificial Sequence
  Synthetic Polynucleotide
ccagctgcrggtcttcaagctgg

SEQ ID NO: 4693 - DNA, 23 bp, Artificial Sequence
  Synthetic Polynucleotide
cacagrccccagggaaggtctgg

SEQ ID NO: 4694 - DNA, 23 bp, Artificial Sequence
  Synthetic Polynucleotide
tcctcrtctgcctcatcttctgg

SEQ ID NO: 4695 - DNA, 23 bp, Artificial Sequence
  Synthetic Polynucleotide
gggcagcrgcctctccgaagagg

SEQ ID NO: 4696 - DNA, 23 bp, Artificial Sequence
  Synthetic Polynucleotide
ggcrggtgctctagcatcacagg

SEQ ID NO: 4697 - DNA, 23 bp, Artificial Sequence
  Synthetic Polynucleotide
gagcaccragcccctgagtgagg

SEQ ID NO: 4698 - DNA, 23 bp, Artificial Sequence
  Synthetic Polynucleotide
cccggggtggtaggtgccayata

SEQ ID NO: 4699 - DNA, 23 bp, Artificial Sequence
  Synthetic Polynucleotide
ccggggtggtaggtgccayatac

SEQ ID NO: 4700 - DNA, 23 bp, Artificial Sequence
  Synthetic Polynucleotide
ccctggtgggcgccatcycgtcc

SEQ ID NO: 4701 - DNA, 23 bp, Artificial Sequence
  Synthetic Polynucleotide
cctggtgggcgccatcycgtcca

SEQ ID NO: 4702 - DNA, 23 bp, Artificial Sequence
  Synthetic Polynucleotide
ccttccgagtcctcygggccctg

SEQ ID NO: 4703 - DNA, 23 bp, Artificial Sequence
  Synthetic Polynucleotide
cctttcttgcactcttcygcctg

SEQ ID NO: 4704 - DNA, 23 bp, Artificial Sequence
  Synthetic Polynucleotide
ccccaggaagccacctcytccgc

SEQ ID NO: 4705 - DNA, 23 bp, Artificial Sequence
  Synthetic Polynucleotide
cccaggaagccacctcytccgcc

SEQ ID NO: 4706 - DNA, 23 bp, Artificial Sequence
  Synthetic Polynucleotide
ccaggaagccacctcytccgccc

SEQ ID NO: 4707 - DNA, 23 bp, Artificial Sequence
  Synthetic Polynucleotide
cctgattgcactcagaccaygcc

SEQ ID NO: 4708 - DNA, 23 bp, Artificial Sequence
  Synthetic Polynucleotide
ccaggagcacggcagygggccct

SEQ ID NO: 4709 - DNA, 23 bp, Artificial Sequence
  Synthetic Polynucleotide
ccttcctcatcatcttcygcatc

SEQ ID NO: 4710 - DNA, 23 bp, Artificial Sequence
  Synthetic Polynucleotide
cctggagccaggtgtcagygact

SEQ ID NO: 4711 - DNA, 23 bp, Artificial Sequence
  Synthetic Polynucleotide
ccagtgcatctcaggycgactgg

SEQ ID NO: 4712 - DNA, 23 bp, Artificial Sequence
  Synthetic Polynucleotide
ccacacccctgtccatagayccc

SEQ ID NO: 4713 - DNA, 23 bp, Artificial Sequence
  Synthetic Polynucleotide
cccctgtccatagaycccagagg

SEQ ID NO: 4714 - DNA, 23 bp, Artificial Sequence
  Synthetic Polynucleotide
cccataggctgtgtccggygctg

SEQ ID NO: 4715 - DNA, 23 bp, Artificial Sequence
  Synthetic Polynucleotide
ccataggctgtgtccggygctgt

SEQ ID NO: 4716 - DNA, 23 bp, Artificial Sequence
  Synthetic Polynucleotide
ccctggtgggcgccatccbgtcc

SEQ ID NO: 4717 - DNA, 23 bp, Artificial Sequence
  Synthetic Polynucleotide
cctggtgggcgccatccbgtcca

SEQ ID NO: 4718 - DNA, 23 bp, Artificial Sequence
  Synthetic Polynucleotide
ccaaggggatccgcaygctgctc

SEQ ID NO: 4719 - DNA, 23 bp, Artificial Sequence
  Synthetic Polynucleotide
ccttccgagtcctccgggycctg

SEQ ID NO: 4720 - DNA, 23 bp, Artificial Sequence
  Synthetic Polynucleotide
ccgagtcctccgggycctgaaaa

SEQ ID NO: 4721 - DNA, 23 bp, Artificial Sequence
  Synthetic Polynucleotide
ccctggcccctgcgcbggaccag

SEQ ID NO: 4722 - DNA, 23 bp, Artificial Sequence
  Synthetic Polynucleotide
cctggcccctgcgcbggaccagt

SEQ ID NO: 4723 - DNA, 23 bp, Artificial Sequence
  Synthetic Polynucleotide
cccaggaagccacctcctcygcc

SEQ ID NO: 4724 - DNA, 23 bp, Artificial Sequence
  Synthetic Polynucleotide
ccaggaagccacctcctcygccc

SEQ ID NO: 4725 - DNA, 23 bp, Artificial Sequence
  Synthetic Polynucleotide
ccaccatgctggaacygtctcgc

SEQ ID NO: 4726 - DNA, 23 bp, Artificial Sequence
  Synthetic Polynucleotide
cccatcaagtcactgcggaygct

SEQ ID NO: 4727 - DNA, 23 bp, Artificial Sequence
  Synthetic Polynucleotide
ccatcaagtcactgcggaygctg

SEQ ID NO: 4728 - DNA, 23 bp, Artificial Sequence
  Synthetic Polynucleotide
cccttctccggacagggacygtg

SEQ ID NO: 4729 - DNA, 23 bp, Artificial Sequence
  Synthetic Polynucleotide
ccttctccggacagggacygtga

SEQ ID NO: 4730 - DNA, 23 bp, Artificial Sequence
  Synthetic Polynucleotide
cccgaaggaaagtgaacgygtgc

SEQ ID NO: 4731 - DNA, 23 bp, Artificial Sequence
  Synthetic Polynucleotide
ccgaaggaaagtgaacgygtgca

SEQ ID NO: 4732 - DNA, 23 bp, Artificial Sequence
  Synthetic Polynucleotide
ccctgggcactggtcyggcgcag

SEQ ID NO: 4733 - DNA, 23 bp, Artificial Sequence
  Synthetic Polynucleotide
cctgggcactggtcyggcgcagg

SEQ ID NO: 4734 - DNA, 23 bp, Artificial Sequence
  Synthetic Polynucleotide
ccccagaagcccatcccayggcc

SEQ ID NO: 4735 - DNA, 23 bp, Artificial Sequence
  Synthetic Polynucleotide
cccagaagcccatcccayggccc

SEQ ID NO: 4736 - DNA, 23 bp, Artificial Sequence
  Synthetic Polynucleotide
ccagaagcccatcccayggcccc

SEQ ID NO: 4737 - DNA, 23 bp, Artificial Sequence
  Synthetic Polynucleotide
ccagatcaccacgtyggccggct

SEQ ID NO: 4738 - DNA, 23 bp, Artificial Sequence
  Synthetic Polynucleotide
cctattccragtcatccgattgg

SEQ ID NO: 4739 - DNA, 23 bp, Artificial Sequence
  Synthetic Polynucleotide
ttagctccragtcttcaaattgg

SEQ ID NO: 4740 - DNA, 23 bp, Artificial Sequence
  Synthetic Polynucleotide
cctgtggttcggctcctyggtgt

SEQ ID NO: 4741 - DNA, 23 bp, Artificial Sequence
  Synthetic Polynucleotide
cccatcccaggcaccccgycccc

SEQ ID NO: 4742 - DNA, 23 bp, Artificial Sequence
  Synthetic Polynucleotide
ccatcccaggcaccccgyccccc

SEQ ID NO: 4743 - DNA, 23 bp, Artificial Sequence
  Synthetic Polynucleotide
atcragtccaagcaagtggtggg

SEQ ID NO: 4744 - DNA, 23 bp, Artificial Sequence
  Synthetic Polynucleotide
catcragtccaagcaagtggtgg

SEQ ID NO: 4745 - DNA, 23 bp, Artificial Sequence
  Synthetic Polynucleotide
gcacatcragtccaagcaagtgg

SEQ ID NO: 4746 - DNA, 23 bp, Artificial Sequence
  Synthetic Polynucleotide
ggagtggtrggcctggaaacagg

SEQ ID NO: 4747 - DNA, 23 bp, Artificial Sequence
  Synthetic Polynucleotide
ccctgatgtctgtcyagaagaac

SEQ ID NO: 4748 - DNA, 23 bp, Artificial Sequence
  Synthetic Polynucleotide
cccccaagtaaaggcttgcygat

SEQ ID NO: 4749 - DNA, 23 bp, Artificial Sequence
  Synthetic Polynucleotide
ccccaagtaaaggcttgcygatg

SEQ ID NO: 4750 - DNA, 23 bp, Artificial Sequence
  Synthetic Polynucleotide
cccaagtaaaggcttgcygatgt

SEQ ID NO: 4751 - DNA, 23 bp, Artificial Sequence
  Synthetic Polynucleotide
ccaagtaaaggcttgcygatgtg

SEQ ID NO: 4752 - DNA, 23 bp, Artificial Sequence
  Synthetic Polynucleotide
ccaacatggtgaaacccygtttc

SEQ ID NO: 4753 - DNA, 23 bp, Artificial Sequence
  Synthetic Polynucleotide
cccagraatggtctggaacacgg

SEQ ID NO: 4754 - DNA, 23 bp, Artificial Sequence
  Synthetic Polynucleotide
cctgaagacgttcgacyggggtg

SEQ ID NO: 4755 - DNA, 23 bp, Artificial Sequence
  Synthetic Polynucleotide
tcttrtgcaatgaacatcaatgg

SEQ ID NO: 4756 - DNA, 23 bp, Artificial Sequence
  Synthetic Polynucleotide
cccattctctctatacygctgcc

SEQ ID NO: 4757 - DNA, 23 bp, Artificial Sequence
  Synthetic Polynucleotide
ccattctctctatacygctgcca

SEQ ID NO: 4758 - DNA, 23 bp, Artificial Sequence
  Synthetic Polynucleotide
ccttgtctgggtcccatygatag

SEQ ID NO: 4759 - DNA, 23 bp, Artificial Sequence
  Synthetic Polynucleotide
agatrgctgcgctgttgctgagg

SEQ ID NO: 4760 - DNA, 23 bp, Artificial Sequence
  Synthetic Polynucleotide
cctggaatgggatcygacacttg

SEQ ID NO: 4761 - DNA, 23 bp, Artificial Sequence
  Synthetic Polynucleotide
tgcrgtgccctaggaggccgagg

SEQ ID NO: 4762 - DNA, 23 bp, Artificial Sequence
  Synthetic Polynucleotide
cctcagctctgttgcttygaact

SEQ ID NO: 4763 - DNA, 23 bp, Artificial Sequence
  Synthetic Polynucleotide
cctgggtctgcttcyggctgctt

SEQ ID NO: 4764 - DNA, 23 bp, Artificial Sequence
  Synthetic Polynucleotide
ccagcagaatgaagaaygggatg

SEQ ID NO: 4765 - DNA, 23 bp, Artificial Sequence
  Synthetic Polynucleotide
cccatgcagcaagcaygacctgc

SEQ ID NO: 4766 - DNA, 23 bp, Artificial Sequence
  Synthetic Polynucleotide
ccatgcagcaagcaygacctgca

SEQ ID NO: 4767 - DNA, 23 bp, Artificial Sequence
  Synthetic Polynucleotide
cccagagacgcatcygcgtgacc

SEQ ID NO: 4768 - DNA, 23 bp, Artificial Sequence
  Synthetic Polynucleotide
cctcctcctccaaatgccyagta

SEQ ID NO: 4769 - DNA, 23 bp, Artificial Sequence
  Synthetic Polynucleotide
cctcctccaaatgccyagtacca

SEQ ID NO: 4770 - DNA, 23 bp, Artificial Sequence
  Synthetic Polynucleotide
catggtrtgatataataagtggg

SEQ ID NO: 4771 - DNA, 23 bp, Artificial Sequence
  Synthetic Polynucleotide
acatggtrtgatataataagtgg

SEQ ID NO: 4772 - DNA, 23 bp, Artificial Sequence
  Synthetic Polynucleotide
cctgctcagagtagcatctygca

SEQ ID NO: 4773 - DNA, 23 bp, Artificial Sequence
  Synthetic Polynucleotide
cgggctcrgggcaaggttcaggg

SEQ ID NO: 4774 - DNA, 23 bp, Artificial Sequence
  Synthetic Polynucleotide
ccgggctcrgggcaaggttcagg

SEQ ID NO: 4775 - DNA, 23 bp, Artificial Sequence
  Synthetic Polynucleotide
gctraggtgaggggcccggctgg

SEQ ID NO: 4776 - DNA, 23 bp, Artificial Sequence
  Synthetic Polynucleotide
tcctgctraggtgaggggcccgg

SEQ ID NO: 4777 - DNA, 23 bp, Artificial Sequence
  Synthetic Polynucleotide
ccaatatcttcttctycccagtg

SEQ ID NO: 4778 - DNA, 23 bp, Artificial Sequence
  Synthetic Polynucleotide
tgatcttcraccacttcacctgg

SEQ ID NO: 4779 - DNA, 23 bp, Artificial Sequence
  Synthetic Polynucleotide
ccccacacaggctgccyataagg

SEQ ID NO: 4780 - DNA, 23 bp, Artificial Sequence
  Synthetic Polynucleotide
cccacacaggctgccyataaggc

SEQ ID NO: 4781 - DNA, 23 bp, Artificial Sequence
  Synthetic Polynucleotide
ccacacaggctgccyataaggct

SEQ ID NO: 4782 - DNA, 23 bp, Artificial Sequence
  Synthetic Polynucleotide
caagrccaacaggcctttcctgg

SEQ ID NO: 4783 - DNA, 23 bp, Artificial Sequence
  Synthetic Polynucleotide
ccaaactgaactgcygactctat

SEQ ID NO: 4784 - DNA, 23 bp, Artificial Sequence
  Synthetic Polynucleotide
cctgtaatgacaccytccagcaa

SEQ ID NO: 4785 - DNA, 23 bp, Artificial Sequence
  Synthetic Polynucleotide
cccatgtgcatttacygctcccc

SEQ ID NO: 4786 - DNA, 23 bp, Artificial Sequence
  Synthetic Polynucleotide
ccatgtgcatttacygctccccg

SEQ ID NO: 4787 - DNA, 23 bp, Artificial Sequence
  Synthetic Polynucleotide
ctgrcccttgtctttggtgaagg

SEQ ID NO: 4788 - DNA, 23 bp, Artificial Sequence
  Synthetic Polynucleotide
cccccagcccagggctgyagcct

SEQ ID NO: 4789 - DNA, 23 bp, Artificial Sequence
  Synthetic Polynucleotide
ccccagcccagggctgyagcctg

SEQ ID NO: 4790 - DNA, 23 bp, Artificial Sequence
  Synthetic Polynucleotide
cccagcccagggctgyagcctgc

SEQ ID NO: 4791 - DNA, 23 bp, Artificial Sequence
  Synthetic Polynucleotide
ccagcccagggctgyagcctgcc

SEQ ID NO: 4792 - DNA, 23 bp, Artificial Sequence
  Synthetic Polynucleotide
cctccgccatctctgtggyccgc

SEQ ID NO: 4793 - DNA, 23 bp, Artificial Sequence
  Synthetic Polynucleotide
ccgccatctctgtggyccgcacc

SEQ ID NO: 4794 - DNA, 23 bp, Artificial Sequence
  Synthetic Polynucleotide
cctaagcagctccctcygacagt

SEQ ID NO: 4795 - DNA, 23 bp, Artificial Sequence
  Synthetic Polynucleotide
cctgaaaaagggtcctygtaagg

SEQ ID NO: 4796 - DNA, 23 bp, Artificial Sequence
  Synthetic Polynucleotide
acgragatggtgagaggtgtggg

SEQ ID NO: 4797 - DNA, 23 bp, Artificial Sequence
  Synthetic Polynucleotide
cacgragatggtgagaggtgtgg

SEQ ID NO: 4798 - DNA, 23 bp, Artificial Sequence
  Synthetic Polynucleotide
caatrtgaccctggtgaggaggg

SEQ ID NO: 4799 - DNA, 23 bp, Artificial Sequence
  Synthetic Polynucleotide
gcaatrtgaccctggtgaggagg

SEQ ID NO: 4800 - DNA, 23 bp, Artificial Sequence
  Synthetic Polynucleotide
ggtgcaatrtgaccctggtgagg

SEQ ID NO: 4801 - DNA, 23 bp, Artificial Sequence
  Synthetic Polynucleotide
cctgccccggtggctcygctaca

SEQ ID NO: 4802 - DNA, 23 bp, Artificial Sequence
  Synthetic Polynucleotide
cccccttcccattgagggcygaa

SEQ ID NO: 4803 - DNA, 23 bp, Artificial Sequence
  Synthetic Polynucleotide
ccccttcccattgagggcygaaa

SEQ ID NO: 4804 - DNA, 23 bp, Artificial Sequence
  Synthetic Polynucleotide
cccttcccattgagggcygaaaa

SEQ ID NO: 4805 - DNA, 23 bp, Artificial Sequence
  Synthetic Polynucleotide
ccttcccattgagggcygaaaag

SEQ ID NO: 4806 - DNA, 23 bp, Artificial Sequence
  Synthetic Polynucleotide
tcggccrcatggaccaaggtggg

SEQ ID NO: 4807 - DNA, 23 bp, Artificial Sequence
  Synthetic Polynucleotide
gtcggccrcatggaccaaggtgg

SEQ ID NO: 4808 - DNA, 23 bp, Artificial Sequence
  Synthetic Polynucleotide
cccccacragacccagaacctgg

SEQ ID NO: 4809 - DNA, 23 bp, Artificial Sequence
  Synthetic Polynucleotide
ccttttattttccagayagcacc

SEQ ID NO: 4810 - DNA, 23 bp, Artificial Sequence
  Synthetic Polynucleotide
caaagartaagtttgtttgtggg

SEQ ID NO: 4811 - DNA, 23 bp, Artificial Sequence
  Synthetic Polynucleotide
ccaaagartaagtttgtttgtgg

SEQ ID NO: 4812 - DNA, 23 bp, Artificial Sequence
  Synthetic Polynucleotide
ccaccgaggccatttacyggcgc

SEQ ID NO: 4813 - DNA, 23 bp, Artificial Sequence
  Synthetic Polynucleotide
ccgaggccatttacyggcgctac

SEQ ID NO: 4814 - DNA, 23 bp, Artificial Sequence
  Synthetic Polynucleotide
cttacarcatcccagcctgaagg

SEQ ID NO: 4815 - DNA, 23 bp, Artificial Sequence
  Synthetic Polynucleotide
gcccrtctctgcttcctcctggg

SEQ ID NO: 4816 - DNA, 23 bp, Artificial Sequence
  Synthetic Polynucleotide
tgcccrtctctgcttcctcctgg

SEQ ID NO: 4817 - DNA, 23 bp, Artificial Sequence
  Synthetic Polynucleotide
cctgccctttgccgagygcctgc

SEQ ID NO: 4818 - DNA, 23 bp, Artificial Sequence
  Synthetic Polynucleotide
cctctgtccaccatggctgyaga

SEQ ID NO: 4819 - DNA, 23 bp, Artificial Sequence
  Synthetic Polynucleotide
ccctggctgcccgagagygagct

SEQ ID NO: 4820 - DNA, 23 bp, Artificial Sequence
  Synthetic Polynucleotide
cctggctgcccgagagygagctc

SEQ ID NO: 4821 - DNA, 23 bp, Artificial Sequence
  Synthetic Polynucleotide
gtgctgrcggcggacgaccaggg

SEQ ID NO: 4822 - DNA, 23 bp, Artificial Sequence
  Synthetic Polynucleotide
cgtgctgrcggcggacgaccagg

SEQ ID NO: 4823 - DNA, 23 bp, Artificial Sequence
  Synthetic Polynucleotide
cggrctcggggccgccttccggg

SEQ ID NO: 4824 - DNA, 23 bp, Artificial Sequence
  Synthetic Polynucleotide
tcggrctcggggccgccttccgg

SEQ ID NO: 4825 - DNA, 23 bp, Artificial Sequence
  Synthetic Polynucleotide
cgggraccgcgtgctggcggcgg

SEQ ID NO: 4826 - DNA, 23 bp, Artificial Sequence
  Synthetic Polynucleotide
ccccgggraccgcgtgctggcgg

SEQ ID NO: 4827 - DNA, 23 bp, Artificial Sequence
  Synthetic Polynucleotide
ccgcctgrcgcacgcgctcctgg

SEQ ID NO: 4828 - DNA, 23 bp, Artificial Sequence
  Synthetic Polynucleotide
ccacggtgcacctggagyagggc

SEQ ID NO: 4829 - DNA, 23 bp, Artificial Sequence
  Synthetic Polynucleotide
ccggagagccaagtgcygcaaac

SEQ ID NO: 4830 - DNA, 23 bp, Artificial Sequence
  Synthetic Polynucleotide
cttttgrcatccagattcgacgg

SEQ ID NO: 4831 - DNA, 23 bp, Artificial Sequence
  Synthetic Polynucleotide
ccccttccacgcccctgcayaga

SEQ ID NO: 4832 - DNA, 23 bp, Artificial Sequence
  Synthetic Polynucleotide
cccttccacgcccctgcayagag

SEQ ID NO: 4833 - DNA, 23 bp, Artificial Sequence
  Synthetic Polynucleotide
ccttccacgcccctgcayagagc

SEQ ID NO: 4834 - DNA, 23 bp, Artificial Sequence
  Synthetic Polynucleotide
ccaatatgaggacaagttcygaa

SEQ ID NO: 4835 - DNA, 23 bp, Artificial Sequence
  Synthetic Polynucleotide
ccagcctggagctgyaggatggt

SEQ ID NO: 4836 - DNA, 23 bp, Artificial Sequence
  Synthetic Polynucleotide
ccgtgggcaaatatygggtgcgc

SEQ ID NO: 4837 - DNA, 23 bp, Artificial Sequence
  Synthetic Polynucleotide
cggcgrctccagggcccccccgg

SEQ ID NO: 4838 - DNA, 23 bp, Artificial Sequence
  Synthetic Polynucleotide
tccrccgaggccgctgcccaggg

SEQ ID NO: 4839 - DNA, 23 bp, Artificial Sequence
  Synthetic Polynucleotide
gtccrccgaggccgctgcccagg

SEQ ID NO: 4840 - DNA, 23 bp, Artificial Sequence
  Synthetic Polynucleotide
cccgagtggttctgactygctct

SEQ ID NO: 4841 - DNA, 23 bp, Artificial Sequence
  Synthetic Polynucleotide
ccgagtggttctgactygctcta

SEQ ID NO: 4842 - DNA, 23 bp, Artificial Sequence
  Synthetic Polynucleotide
aagatccrtgtgttcgtaggcgg

SEQ ID NO: 4843 - DNA, 23 bp, Artificial Sequence
  Synthetic Polynucleotide
cctacttcctcatctccyggagt

SEQ ID NO: 4844 - DNA, 23 bp, Artificial Sequence
  Synthetic Polynucleotide
cctttggctacaacaygatcgat

SEQ ID NO: 4845 - DNA, 23 bp, Artificial Sequence
  Synthetic Polynucleotide
ccgagggactagagygagtccta

SEQ ID NO: 4846 - DNA, 23 bp, Artificial Sequence
  Synthetic Polynucleotide
cccaactggagacccygattccg

SEQ ID NO: 4847 - DNA, 23 bp, Artificial Sequence
  Synthetic Polynucleotide
ccaactggagacccygattccgc

SEQ ID NO: 4848 - DNA, 23 bp, Artificial Sequence
  Synthetic Polynucleotide
tcccrtcccggtcagggtggcgg

SEQ ID NO: 4849 - DNA, 23 bp, Artificial Sequence
  Synthetic Polynucleotide
gggtcccrtcccggtcagggtgg

SEQ ID NO: 4850 - DNA, 23 bp, Artificial Sequence
  Synthetic Polynucleotide
ccatgtgtgtagaactyagaaag

SEQ ID NO: 4851 - DNA, 23 bp, Artificial Sequence
  Synthetic Polynucleotide
ccagcgctttctggctyagctca

SEQ ID NO: 4852 - DNA, 23 bp, Artificial Sequence
  Synthetic Polynucleotide
ccgcgcgcggcttcyagcctccc

SEQ ID NO: 4853 - DNA, 23 bp, Artificial Sequence
  Synthetic Polynucleotide
ccagtgtgctgctctgctygtta

SEQ ID NO: 4854 - DNA, 23 bp, Artificial Sequence
  Synthetic Polynucleotide
gtgcrgaagctcatgcaggtagg

SEQ ID NO: 4855 - DNA, 23 bp, Artificial Sequence
  Synthetic Polynucleotide
cacggtgcrgaagctcatgcagg

SEQ ID NO: 4856 - DNA, 23 bp, Artificial Sequence
  Synthetic Polynucleotide
ccacccccagacgaggccygcag

SEQ ID NO: 4857 - DNA, 23 bp, Artificial Sequence
  Synthetic Polynucleotide
cccccagacgaggccygcaggga

SEQ ID NO: 4858 - DNA, 23 bp, Artificial Sequence
  Synthetic Polynucleotide
ccccagacgaggccygcagggac

SEQ ID NO: 4859 - DNA, 23 bp, Artificial Sequence
  Synthetic Polynucleotide
cctcaggccgtccgagcycttcc

SEQ ID NO: 4860 - DNA, 23 bp, Artificial Sequence
  Synthetic Polynucleotide
cccgtctctccccagggacyggt

SEQ ID NO: 4861 - DNA, 23 bp, Artificial Sequence
  Synthetic Polynucleotide
ccgtctctccccagggacyggtt

SEQ ID NO: 4862 - DNA, 23 bp, Artificial Sequence
  Synthetic Polynucleotide
ctgracactgctgcagctggtgg

SEQ ID NO: 4863 - DNA, 23 bp, Artificial Sequence
  Synthetic Polynucleotide
ggactgracactgctgcagctgg

SEQ ID NO: 4864 - DNA, 23 bp, Artificial Sequence
  Synthetic Polynucleotide
gccrcttccgccagccacagtgg

SEQ ID NO: 4865 - DNA, 23 bp, Artificial Sequence
  Synthetic Polynucleotide
agaccagcrcggggcgcgggcgg

SEQ ID NO: 4866 - DNA, 23 bp, Artificial Sequence
  Synthetic Polynucleotide
cctgaaggccatcgcctycctgc

SEQ ID NO: 4867 - DNA, 23 bp, Artificial Sequence
  Synthetic Polynucleotide
tttgccccrgcgctattccatgg

SEQ ID NO: 4868 - DNA, 23 bp, Artificial Sequence
  Synthetic Polynucleotide
ccccratggctcatctctcaggg

SEQ ID NO: 4869 - DNA, 23 bp, Artificial Sequence
  Synthetic Polynucleotide
cccccratggctcatctctcagg

SEQ ID NO: 4870 - DNA, 23 bp, Artificial Sequence
  Synthetic Polynucleotide
ccaactatgtggcagyatttgtc

SEQ ID NO: 4871 - DNA, 23 bp, Artificial Sequence
  Synthetic Polynucleotide
cctcggccacgccagcgyccagg

SEQ ID NO: 4872 - DNA, 23 bp, Artificial Sequence
  Synthetic Polynucleotide
tttcratcctcaccccagtttgg

SEQ ID NO: 4873 - DNA, 23 bp, Artificial Sequence
  Synthetic Polynucleotide
ccaargtaaccgcgggcccgagg

SEQ ID NO: 4874 - DNA, 23 bp, Artificial Sequence
  Synthetic Polynucleotide
tcggtgrctatgaactgagccgg

SEQ ID NO: 4875 - DNA, 23 bp, Artificial Sequence
  Synthetic Polynucleotide
gagttggtrggatttgcctctgg

SEQ ID NO: 4876 - DNA, 23 bp, Artificial Sequence
  Synthetic Polynucleotide
attcragcattccctgccaatgg

SEQ ID NO: 4877 - DNA, 23 bp, Artificial Sequence
  Synthetic Polynucleotide
ccctgccaatggagcaytctttt

SEQ ID NO: 4878 - DNA, 23 bp, Artificial Sequence
  Synthetic Polynucleotide
cctgccaatggagcaytcttttt

SEQ ID NO: 4879 - DNA, 23 bp, Artificial Sequence
  Synthetic Polynucleotide
ccaggagtttgggatcygaggca

SEQ ID NO: 4880 - DNA, 23 bp, Artificial Sequence
  Synthetic Polynucleotide
cttggagraattattagctgtgg

SEQ ID NO: 4881 - DNA, 23 bp, Artificial Sequence
  Synthetic Polynucleotide
tgctgcagrtgaggaccgcgcgg

SEQ ID NO: 4882 - DNA, 23 bp, Artificial Sequence
  Synthetic Polynucleotide
tgttgragtgagatcactgcggg

SEQ ID NO: 4883 - DNA, 23 bp, Artificial Sequence
  Synthetic Polynucleotide
ttgttgragtgagatcactgcgg

SEQ ID NO: 4884 - DNA, 23 bp, Artificial Sequence
  Synthetic Polynucleotide
ccactgctctttcccgcayggcc

SEQ ID NO: 4885 - DNA, 23 bp, Artificial Sequence
  Synthetic Polynucleotide
cccgtatcactgtctyggattca

SEQ ID NO: 4886 - DNA, 23 bp, Artificial Sequence
  Synthetic Polynucleotide
ccgtatcactgtctyggattcat

SEQ ID NO: 4887 - DNA, 23 bp, Artificial Sequence
  Synthetic Polynucleotide
aagacgrccctgatcttcgaggg

SEQ ID NO: 4888 - DNA, 23 bp, Artificial Sequence
  Synthetic Polynucleotide
caagacgrccctgatcttcgagg

SEQ ID NO: 4889 - DNA, 23 bp, Artificial Sequence
  Synthetic Polynucleotide
caacrgctacctcagcaccctgg

SEQ ID NO: 4890 - DNA, 23 bp, Artificial Sequence
  Synthetic Polynucleotide
gtggccrgcagctcaccgcctgg

SEQ ID NO: 4891 - DNA, 23 bp, Artificial Sequence
  Synthetic Polynucleotide
cctgaagactgtggtcttcyagt

SEQ ID NO: 4892 - DNA, 23 bp, Artificial Sequence
  Synthetic Polynucleotide
ctttgrccggtaagtaggagagg

SEQ ID NO: 4893 - DNA, 23 bp, Artificial Sequence
  Synthetic Polynucleotide
aagrtgagtcgcgcgcccgcggg

SEQ ID NO: 4894 - DNA, 23 bp, Artificial Sequence
  Synthetic Polynucleotide
caagrtgagtcgcgcgcccgcgg

SEQ ID NO: 4895 - DNA, 23 bp, Artificial Sequence
  Synthetic Polynucleotide
tggctccrgtatcgtcaacacgg

SEQ ID NO: 4896 - DNA, 23 bp, Artificial Sequence
  Synthetic Polynucleotide
ccgcaacgaggagaacygggcca

SEQ ID NO: 4897 - DNA, 23 bp, Artificial Sequence
  Synthetic Polynucleotide
ccttcactgtcgtgtyggtgagt

SEQ ID NO: 4898 - DNA, 23 bp, Artificial Sequence
  Synthetic Polynucleotide
cccagtgctaaagaagctgygcg

SEQ ID NO: 4899 - DNA, 23 bp, Artificial Sequence
  Synthetic Polynucleotide
ccagtgctaaagaagctgygcgg

SEQ ID NO: 4900 - DNA, 23 bp, Artificial Sequence
  Synthetic Polynucleotide
ccaattccagctacygacagcct

SEQ ID NO: 4901 - DNA, 23 bp, Artificial Sequence
  Synthetic Polynucleotide
ccgctgccattctgctayagatg

SEQ ID NO: 4902 - DNA, 23 bp, Artificial Sequence
  Synthetic Polynucleotide
cggtgcacrggatcttcaactgg

SEQ ID NO: 4903 - DNA, 23 bp, Artificial Sequence
  Synthetic Polynucleotide
gaagccgraggagagacaggagg

SEQ ID NO: 4904 - DNA, 23 bp, Artificial Sequence
  Synthetic Polynucleotide
ccagccccaaccgctgcyatgtt

SEQ ID NO: 4905 - DNA, 23 bp, Artificial Sequence
  Synthetic Polynucleotide
ccttctacaatgtgggcygctca

SEQ ID NO: 4906 - DNA, 23 bp, Artificial Sequence
  Synthetic Polynucleotide
ttcacgtrgacaaacttcattgg

SEQ ID NO: 4907 - DNA, 23 bp, Artificial Sequence
  Synthetic Polynucleotide
ccacrccattgtgggactcatgg

SEQ ID NO: 4908 - DNA, 23 bp, Artificial Sequence
  Synthetic Polynucleotide
gtatttgrtttctcctcgtatgg

SEQ ID NO: 4909 - DNA, 23 bp, Artificial Sequence
  Synthetic Polynucleotide
ccttcttcctcctaygaaacatc

SEQ ID NO: 4910 - DNA, 23 bp, Artificial Sequence
  Synthetic Polynucleotide
ccagcacagagaccactcyccag

SEQ ID NO: 4911 - DNA, 23 bp, Artificial Sequence
  Synthetic Polynucleotide
tcctggrttccctcatggtgggg

SEQ ID NO: 4912 - DNA, 23 bp, Artificial Sequence
  Synthetic Polynucleotide
ctcctggrttccctcatggtggg

SEQ ID NO: 4913 - DNA, 23 bp, Artificial Sequence
  Synthetic Polynucleotide
cctcctggrttccctcatggtgg

SEQ ID NO: 4914 - DNA, 23 bp, Artificial Sequence
  Synthetic Polynucleotide
gaccrggctggccacctcgctgg

SEQ ID NO: 4915 - DNA, 23 bp, Artificial Sequence
  Synthetic Polynucleotide
ccaggtacgtcgccygcctcagt

SEQ ID NO: 4916 - DNA, 23 bp, Artificial Sequence
  Synthetic Polynucleotide
ttgctgccracttcattgatggg

SEQ ID NO: 4917 - DNA, 23 bp, Artificial Sequence
  Synthetic Polynucleotide
ccargttttggaggtgccctggg

SEQ ID NO: 4918 - DNA, 23 bp, Artificial Sequence
  Synthetic Polynucleotide
tccargttttggaggtgccctgg

SEQ ID NO: 4919 - DNA, 23 bp, Artificial Sequence
  Synthetic Polynucleotide
ccagagctggcaatgyagggagc

SEQ ID NO: 4920 - DNA, 23 bp, Artificial Sequence
  Synthetic Polynucleotide
cacagrcctgtccatcctcatgg

SEQ ID NO: 4921 - DNA, 23 bp, Artificial Sequence
  Synthetic Polynucleotide
gcagcrgatcagtggactcctgg

SEQ ID NO: 4922 - DNA, 23 bp, Artificial Sequence
  Synthetic Polynucleotide
ctggggragaatggggcctgggg

SEQ ID NO: 4923 - DNA, 23 bp, Artificial Sequence
  Synthetic Polynucleotide
cctggggragaatggggcctggg

SEQ ID NO: 4924 - DNA, 23 bp, Artificial Sequence
  Synthetic Polynucleotide
acctggggragaatggggcctgg

SEQ ID NO: 4925 - DNA, 23 bp, Artificial Sequence
  Synthetic Polynucleotide
atcrtgggccgcgtgtggatcgg

SEQ ID NO: 4926 - DNA, 23 bp, Artificial Sequence
  Synthetic Polynucleotide
agtacatcrtgggccgcgtgtgg

SEQ ID NO: 4927 - DNA, 23 bp, Artificial Sequence
  Synthetic Polynucleotide
cccrcggtgcgggttatgctggg

SEQ ID NO: 4928 - DNA, 23 bp, Artificial Sequence
  Synthetic Polynucleotide
acccrcggtgcgggttatgctgg

SEQ ID NO: 4929 - DNA, 23 bp, Artificial Sequence
  Synthetic Polynucleotide
ccgatgccccctccgagyaggca

SEQ ID NO: 4930 - DNA, 23 bp, Artificial Sequence
  Synthetic Polynucleotide
ccaactcctcagccyggggctgg

SEQ ID NO: 4931 - DNA, 23 bp, Artificial Sequence
  Synthetic Polynucleotide
cctcatcctcactgtgcygctgc

SEQ ID NO: 4932 - DNA, 23 bp, Artificial Sequence
  Synthetic Polynucleotide
cctcactgtgccgctgyggcgcg

SEQ ID NO: 4933 - DNA, 23 bp, Artificial Sequence
  Synthetic Polynucleotide
gagacgcrgctgacctcgctggg

SEQ ID NO: 4934 - DNA, 23 bp, Artificial Sequence
  Synthetic Polynucleotide
ggagacgcrgctgacctcgctgg

SEQ ID NO: 4935 - DNA, 23 bp, Artificial Sequence
  Synthetic Polynucleotide
cccatccrgtacaggcgggtggg

SEQ ID NO: 4936 - DNA, 23 bp, Artificial Sequence
  Synthetic Polynucleotide
ccccatccrgtacaggcgggtgg

SEQ ID NO: 4937 - DNA, 23 bp, Artificial Sequence
  Synthetic Polynucleotide
acacagrgctgtctctgtttggg

SEQ ID NO: 4938 - DNA, 23 bp, Artificial Sequence
  Synthetic Polynucleotide
aacacagrgctgtctctgtttgg

SEQ ID NO: 4939 - DNA, 23 bp, Artificial Sequence
  Synthetic Polynucleotide
caatgacragaacacagacgggg

SEQ ID NO: 4940 - DNA, 23 bp, Artificial Sequence
  Synthetic Polynucleotide
tcaatgacragaacacagacggg

SEQ ID NO: 4941 - DNA, 23 bp, Artificial Sequence
  Synthetic Polynucleotide
cctgcacccctgcgtgygagaga

SEQ ID NO: 4942 - DNA, 23 bp, Artificial Sequence
  Synthetic Polynucleotide
ccatgatccccatcyggtacagg

SEQ ID NO: 4943 - DNA, 23 bp, Artificial Sequence
  Synthetic Polynucleotide
ttcrcctttggattggcctgtgg

SEQ ID NO: 4944 - DNA, 23 bp, Artificial Sequence
  Synthetic Polynucleotide
ccagaccctaaggcctatyagct

SEQ ID NO: 4945 - DNA, 23 bp, Artificial Sequence
  Synthetic Polynucleotide
cctgccgttcatgagcyggctgc

SEQ ID NO: 4946 - DNA, 23 bp, Artificial Sequence
  Synthetic Polynucleotide
ctgrcttcccgtggtgcaggcgg

SEQ ID NO: 4947 - DNA, 23 bp, Artificial Sequence
  Synthetic Polynucleotide
ggcctgrcttcccgtggtgcagg

SEQ ID NO: 4948 - DNA, 23 bp, Artificial Sequence
  Synthetic Polynucleotide
cctgaccatcttcctcatcygag

SEQ ID NO: 4949 - DNA, 23 bp, Artificial Sequence
  Synthetic Polynucleotide
ccatcttcctcatcygaggcctg

SEQ ID NO: 4950 - DNA, 23 bp, Artificial Sequence
  Synthetic Polynucleotide
gccrtgaaatacaccacctgcgg

SEQ ID NO: 4951 - DNA, 23 bp, Artificial Sequence
  Synthetic Polynucleotide
ctacagrtgagcccctagcaggg

SEQ ID NO: 4952 - DNA, 23 bp, Artificial Sequence
  Synthetic Polynucleotide
gctacagrtgagcccctagcagg

SEQ ID NO: 4953 - DNA, 23 bp, Artificial Sequence
  Synthetic Polynucleotide
cccagcctgtactggyggctgtg

SEQ ID NO: 4954 - DNA, 23 bp, Artificial Sequence
  Synthetic Polynucleotide
ccagcctgtactggyggctgtgc

SEQ ID NO: 4955 - DNA, 23 bp, Artificial Sequence
  Synthetic Polynucleotide
cctgtatgatcgggtacygacct

SEQ ID NO: 4956 - DNA, 23 bp, Artificial Sequence
  Synthetic Polynucleotide
catcagcrggctggtgctcctgg

SEQ ID NO: 4957 - DNA, 23 bp, Artificial Sequence
  Synthetic Polynucleotide
catcrggatccccctggtgacgg

SEQ ID NO: 4958 - DNA, 23 bp, Artificial Sequence
  Synthetic Polynucleotide
ccattatcatcgggatccycctg

SEQ ID NO: 4959 - DNA, 23 bp, Artificial Sequence
  Synthetic Polynucleotide
gggcrgggtgcttgtgggcgtgg

SEQ ID NO: 4960 - DNA, 23 bp, Artificial Sequence
  Synthetic Polynucleotide
ggacragaccaagctgctggtgg

SEQ ID NO: 4961 - DNA, 23 bp, Artificial Sequence
  Synthetic Polynucleotide
cggggacragaccaagctgctgg

SEQ ID NO: 4962 - DNA, 23 bp, Artificial Sequence
  Synthetic Polynucleotide
tcataartatccttaattgaggg

SEQ ID NO: 4963 - DNA, 23 bp, Artificial Sequence
  Synthetic Polynucleotide
atcataartatccttaattgagg

SEQ ID NO: 4964 - DNA, 23 bp, Artificial Sequence
  Synthetic Polynucleotide
ccaaattacgggagttcyagttg

SEQ ID NO: 4965 - DNA, 23 bp, Artificial Sequence
  Synthetic Polynucleotide
tggattgragcctggtggctagg

SEQ ID NO: 4966 - DNA, 23 bp, Artificial Sequence
  Synthetic Polynucleotide
acaaatcrgaagatgtttggagg

SEQ ID NO: 4967 - DNA, 23 bp, Artificial Sequence
  Synthetic Polynucleotide
cctgatcttctgctgcttcygag

SEQ ID NO: 4968 - DNA, 23 bp, Artificial Sequence
  Synthetic Polynucleotide
ccgtggggcctggcctcayctgc

SEQ ID NO: 4969 - DNA, 23 bp, Artificial Sequence
  Synthetic Polynucleotide
tgtcaacargaatgcagcagtgg

SEQ ID NO: 4970 - DNA, 23 bp, Artificial Sequence
  Synthetic Polynucleotide
tacragctgaaccagcgcgtcgg

SEQ ID NO: 4971 - DNA, 23 bp, Artificial Sequence
  Synthetic Polynucleotide
tttraaatggatgttcaggtagg

SEQ ID NO: 4972 - DNA, 23 bp, Artificial Sequence
  Synthetic Polynucleotide
ttactttraaatggatgttcagg

SEQ ID NO: 4973 - DNA, 23 bp, Artificial Sequence
  Synthetic Polynucleotide
gatrgatacgtggacccttctgg

SEQ ID NO: 4974 - DNA, 23 bp, Artificial Sequence
  Synthetic Polynucleotide
gatgratacgtggacccttctgg

SEQ ID NO: 4975 - DNA, 23 bp, Artificial Sequence
  Synthetic Polynucleotide
cagttgraatgtaaaggtgaagg

SEQ ID NO: 4976 - DNA, 23 bp, Artificial Sequence
  Synthetic Polynucleotide
ccatatcactacgaaygagttgt

SEQ ID NO: 4977 - DNA, 23 bp, Artificial Sequence
  Synthetic Polynucleotide
tggcctggrcttaaatcttcagg

SEQ ID NO: 4978 - DNA, 23 bp, Artificial Sequence
  Synthetic Polynucleotide
cctcttgactgggacccygctgc

SEQ ID NO: 4979 - DNA, 23 bp, Artificial Sequence
  Synthetic Polynucleotide
cagcgactrgaatcctcaccagg

SEQ ID NO: 4980 - DNA, 23 bp, Artificial Sequence
  Synthetic Polynucleotide
gctcaagrtacatgctggagagg

SEQ ID NO: 4981 - DNA, 23 bp, Artificial Sequence
  Synthetic Polynucleotide
ccgatgcccgggatgcagyagca

SEQ ID NO: 4982 - DNA, 23 bp, Artificial Sequence
  Synthetic Polynucleotide
cctgcaagcgcaggacygagccc

SEQ ID NO: 4983 - DNA, 23 bp, Artificial Sequence
  Synthetic Polynucleotide
gatgaggcrtcttgccaacacgg

SEQ ID NO: 4984 - DNA, 23 bp, Artificial Sequence
  Synthetic Polynucleotide
ccatgagaacgcatctyagcccg

SEQ ID NO: 4985 - DNA, 23 bp, Artificial Sequence
  Synthetic Polynucleotide
gagcagccrccagcagcgaaagg

SEQ ID NO: 4986 - DNA, 23 bp, Artificial Sequence
  Synthetic Polynucleotide
cccatggactgcagatgyggctc

SEQ ID NO: 4987 - DNA, 23 bp, Artificial Sequence
  Synthetic Polynucleotide
ccatggactgcagatgyggctca

SEQ ID NO: 4988 - DNA, 23 bp, Artificial Sequence
  Synthetic Polynucleotide
cccttaggtaagtcaaatytcat

SEQ ID NO: 4989 - DNA, 23 bp, Artificial Sequence
  Synthetic Polynucleotide
ccttaggtaagtcaaatytcatg

SEQ ID NO: 4990 - DNA, 23 bp, Artificial Sequence
  Synthetic Polynucleotide
gagcgatrattctgacatttggg

SEQ ID NO: 4991 - DNA, 23 bp, Artificial Sequence
  Synthetic Polynucleotide
agagcgatrattctgacatttgg

SEQ ID NO: 4992 - DNA, 23 bp, Artificial Sequence
  Synthetic Polynucleotide
ccataagrgccacccaccctcgg

SEQ ID NO: 4993 - DNA, 23 bp, Artificial Sequence
  Synthetic Polynucleotide
cccacatgrattggtgttgctgg

SEQ ID NO: 4994 - DNA, 23 bp, Artificial Sequence
  Synthetic Polynucleotide
accaagragggagtggtgcatgg

SEQ ID NO: 4995 - DNA, 23 bp, Artificial Sequence
  Synthetic Polynucleotide
gagctrtgttctctggggcaggg

SEQ ID NO: 4996 - DNA, 23 bp, Artificial Sequence
  Synthetic Polynucleotide
ggagctrtgttctctggggcagg

SEQ ID NO: 4997 - DNA, 23 bp, Artificial Sequence
  Synthetic Polynucleotide
tagcttccrtccagtgcctctgg

SEQ ID NO: 4998 - DNA, 23 bp, Artificial Sequence
  Synthetic Polynucleotide
cctgaccgtgggccacygagccc

SEQ ID NO: 4999 - DNA, 23 bp, Artificial Sequence
  Synthetic Polynucleotide
aagrccgtgtgcgtgctgaaggg

SEQ ID NO: 5000 - DNA, 23 bp, Artificial Sequence
  Synthetic Polynucleotide
gaagrccgtgtgcgtgctgaagg

SEQ ID NO: 5001 - DNA, 23 bp, Artificial Sequence
  Synthetic Polynucleotide
gtttgrcttgtggtgtaattggg

SEQ ID NO: 5002 - DNA, 23 bp, Artificial Sequence
  Synthetic Polynucleotide
cgtttgrcttgtggtgtaattgg

SEQ ID NO: 5003 - DNA, 23 bp, Artificial Sequence
  Synthetic Polynucleotide
ttcragcagaaggcaagggctgg

SEQ ID NO: 5004 - DNA, 23 bp, Artificial Sequence
  Synthetic Polynucleotide
caatttcragcagaaggcaaggg

SEQ ID NO: 5005 - DNA, 23 bp, Artificial Sequence
  Synthetic Polynucleotide
tcaatttcragcagaaggcaagg

SEQ ID NO: 5006 - DNA, 23 bp, Artificial Sequence
  Synthetic Polynucleotide
ggttggragggaaaagacattgg

SEQ ID NO: 5007 - DNA, 23 bp, Artificial Sequence
  Synthetic Polynucleotide
tttaraagaaagagtagctgtgg

SEQ ID NO: 5008 - DNA, 23 bp, Artificial Sequence
  Synthetic Polynucleotide
gtgttrtaatgaatttataatgg

SEQ ID NO: 5009 - DNA, 23 bp, Artificial Sequence
  Synthetic Polynucleotide
gcaagtgrtggcgacctagtggg

SEQ ID NO: 5010 - DNA, 23 bp, Artificial Sequence
  Synthetic Polynucleotide
ggcaagtgrtggcgacctagtgg

SEQ ID NO: 5011 - DNA, 23 bp, Artificial Sequence
  Synthetic Polynucleotide
gtgtartggagggccaggggtgg

SEQ ID NO: 5012 - DNA, 23 bp, Artificial Sequence
  Synthetic Polynucleotide
tccgtgtartggagggccagggg

SEQ ID NO: 5013 - DNA, 23 bp, Artificial Sequence
  Synthetic Polynucleotide
ccgcggcaagtggtggygaccta

SEQ ID NO: 5014 - DNA, 23 bp, Artificial Sequence
  Synthetic Polynucleotide
ccgtgtagtggagggcyaggggt

SEQ ID NO: 5015 - DNA, 23 bp, Artificial Sequence
  Synthetic Polynucleotide
tttgtrtgaaagaagagaagggg

SEQ ID NO: 5016 - DNA, 23 bp, Artificial Sequence
  Synthetic Polynucleotide
ttttgtrtgaaagaagagaaggg

SEQ ID NO: 5017 - DNA, 23 bp, Artificial Sequence
  Synthetic Polynucleotide
cttttgtrtgaaagaagagaagg

SEQ ID NO: 5018 - DNA, 23 bp, Artificial Sequence
  Synthetic Polynucleotide
cagrtgagtgtggtttgctatgg

SEQ ID NO: 5019 - DNA, 23 bp, Artificial Sequence
  Synthetic Polynucleotide
tatacarcctggcctatggcagg

SEQ ID NO: 5020 - DNA, 23 bp, Artificial Sequence
  Synthetic Polynucleotide
gtcracagtagttcttcccatgg

SEQ ID NO: 5021 - DNA, 23 bp, Artificial Sequence
  Synthetic Polynucleotide
cctcaggactcctgtgtgygaca

SEQ ID NO: 5022 - DNA, 23 bp, Artificial Sequence
  Synthetic Polynucleotide
ccccgccgaggcgatggggyagc

SEQ ID NO: 5023 - DNA, 23 bp, Artificial Sequence
  Synthetic Polynucleotide
cccgccgaggcgatggggyagct

SEQ ID NO: 5024 - DNA, 23 bp, Artificial Sequence
  Synthetic Polynucleotide
ccgccgaggcgatggggyagctc

SEQ ID NO: 5025 - DNA, 23 bp, Artificial Sequence
  Synthetic Polynucleotide
ccgaggcgatggggyagctcggc

SEQ ID NO: 5026 - DNA, 23 bp, Artificial Sequence
  Synthetic Polynucleotide
cctcartggtggttctggcgggg

SEQ ID NO: 5027 - DNA, 23 bp, Artificial Sequence
  Synthetic Polynucleotide
tcctcartggtggttctggcggg

SEQ ID NO: 5028 - DNA, 23 bp, Artificial Sequence
  Synthetic Polynucleotide
gtcctcartggtggttctggcgg

SEQ ID NO: 5029 - DNA, 23 bp, Artificial Sequence
  Synthetic Polynucleotide
ccctctgtgccctgcaacytttc

SEQ ID NO: 5030 - DNA, 23 bp, Artificial Sequence
  Synthetic Polynucleotide
cctctgtgccctgcaacytttca

SEQ ID NO: 5031 - DNA, 23 bp, Artificial Sequence
  Synthetic Polynucleotide
cctgagtgactccactyaagtga

SEQ ID NO: 5032 - DNA, 23 bp, Artificial Sequence
  Synthetic Polynucleotide
ccagagccgccgtgattyctcca

SEQ ID NO: 5033 - DNA, 23 bp, Artificial Sequence
  Synthetic Polynucleotide
cggggtrtggtggagtactttgg

SEQ ID NO: 5034 - DNA, 23 bp, Artificial Sequence
  Synthetic Polynucleotide
cgccagrcaagtgaaccaagagg

SEQ ID NO: 5035 - DNA, 23 bp, Artificial Sequence
  Synthetic Polynucleotide
ccttgtacccacatctccygcca

SEQ ID NO: 5036 - DNA, 23 bp, Artificial Sequence
  Synthetic Polynucleotide
ccaccgtgtgctcaggaggygcc

SEQ ID NO: 5037 - DNA, 23 bp, Artificial Sequence
  Synthetic Polynucleotide
ccgtgtgctcaggaggygccccg

SEQ ID NO: 5038 - DNA, 23 bp, Artificial Sequence
  Synthetic Polynucleotide
ccaccgagccccagtacyagccc

SEQ ID NO: 5039 - DNA, 23 bp, Artificial Sequence
  Synthetic Polynucleotide
ccgagccccagtacyagcccggg

SEQ ID NO: 5040 - DNA, 23 bp, Artificial Sequence
  Synthetic Polynucleotide
ccagcacctaggcctygacccac

SEQ ID NO: 5041 - DNA, 23 bp, Artificial Sequence
  Synthetic Polynucleotide
ccgagaggagctcaaayaggcag

SEQ ID NO: 5042 - DNA, 23 bp, Artificial Sequence
  Synthetic Polynucleotide
agagrcactgccttctgcactgg

SEQ ID NO: 5043 - DNA, 23 bp, Artificial Sequence
  Synthetic Polynucleotide
tcctcrgtgagatcattgaatgg

SEQ ID NO: 5044 - DNA, 23 bp, Artificial Sequence
  Synthetic Polynucleotide
tcgtgtrgtctcgcgatcagagg

SEQ ID NO: 5045 - DNA, 23 bp, Artificial Sequence
  Synthetic Polynucleotide
ccaggagrcacagaaattacagg

SEQ ID NO: 5046 - DNA, 23 bp, Artificial Sequence
  Synthetic Polynucleotide
aaaatrgccattcttccaggagg

SEQ ID NO: 5047 - DNA, 23 bp, Artificial Sequence
  Synthetic Polynucleotide
cgaaaaatrgccattcttccagg

SEQ ID NO: 5048 - DNA, 23 bp, Artificial Sequence
  Synthetic Polynucleotide
ccatraacgcattcatcgtgtgg

SEQ ID NO: 5049 - DNA, 23 bp, Artificial Sequence
  Synthetic Polynucleotide
ccttgtttttgacaatgyaatca

SEQ ID NO: 5050 - DNA, 23 bp, Artificial Sequence
  Synthetic Polynucleotide
ccttagccattctgggtaygact

SEQ ID NO: 5051 - DNA, 23 bp, Artificial Sequence
  Synthetic Polynucleotide
cccgccaaactgacttyatcgca

SEQ ID NO: 5052 - DNA, 23 bp, Artificial Sequence
  Synthetic Polynucleotide
ccgccaaactgacttyatcgcac

SEQ ID NO: 5053 - DNA, 23 bp, Artificial Sequence
  Synthetic Polynucleotide
ccaggagctagaaaaagagygac

SEQ ID NO: 5054 - DNA, 23 bp, Artificial Sequence
  Synthetic Polynucleotide
ccatcacagaccttygatgagcg

SEQ ID NO: 5055 - DNA, 23 bp, Artificial Sequence
  Synthetic Polynucleotide
ccaccccgtcggtacttcygctc

SEQ ID NO: 5056 - DNA, 23 bp, Artificial Sequence
  Synthetic Polynucleotide
ccccgtcggtacttcygctctgg

SEQ ID NO: 5057 - DNA, 23 bp, Artificial Sequence
  Synthetic Polynucleotide
cccgtcggtacttcygctctgga

SEQ ID NO: 5058 - DNA, 23 bp, Artificial Sequence
  Synthetic Polynucleotide
cccaagagcatcatcaacyaggt

SEQ ID NO: 5059 - DNA, 23 bp, Artificial Sequence
  Synthetic Polynucleotide
ccaagagcatcatcaacyaggtc

SEQ ID NO: 5060 - DNA, 23 bp, Artificial Sequence
  Synthetic Polynucleotide
ccgtgactttgtgagcgtgygct

SEQ ID NO: 5061 - DNA, 23 bp, Artificial Sequence
  Synthetic Polynucleotide
cccaggttcactatagttgygga

SEQ ID NO: 5062 - DNA, 23 bp, Artificial Sequence
  Synthetic Polynucleotide
ccaggttcactatagttgyggag

SEQ ID NO: 5063 - DNA, 23 bp, Artificial Sequence
  Synthetic Polynucleotide
cagrtcgttctgtaggaaatggg

SEQ ID NO: 5064 - DNA, 23 bp, Artificial Sequence
  Synthetic Polynucleotide
gcagrtcgttctgtaggaaatgg

SEQ ID NO: 5065 - DNA, 23 bp, Artificial Sequence
  Synthetic Polynucleotide
cccctgtgattcagatccyggaa

SEQ ID NO: 5066 - DNA, 23 bp, Artificial Sequence
  Synthetic Polynucleotide
ccctgtgattcagatccyggaaa

SEQ ID NO: 5067 - DNA, 23 bp, Artificial Sequence
  Synthetic Polynucleotide
cctgtgattcagatccyggaaat

SEQ ID NO: 5068 - DNA, 23 bp, Artificial Sequence
  Synthetic Polynucleotide
ccagacgtttgaggagctgygac

SEQ ID NO: 5069 - DNA, 23 bp, Artificial Sequence
  Synthetic Polynucleotide
cctargttcgggaggccttgagg

SEQ ID NO: 5070 - DNA, 23 bp, Artificial Sequence
  Synthetic Polynucleotide
ccagcggctgaaggagctgyggg

SEQ ID NO: 5071 - DNA, 23 bp, Artificial Sequence
  Synthetic Polynucleotide
tgcacaagracatcaagccgggg

SEQ ID NO: 5072 - DNA, 23 bp, Artificial Sequence
  Synthetic Polynucleotide
cctggagtacctgcatagcyagg

SEQ ID NO: 5073 - DNA, 23 bp, Artificial Sequence
  Synthetic Polynucleotide
ccatccggcagatcyggcagcac

SEQ ID NO: 5074 - DNA, 23 bp, Artificial Sequence
  Synthetic Polynucleotide
ttccrcaagacggccctgttggg

SEQ ID NO: 5075 - DNA, 23 bp, Artificial Sequence
  Synthetic Polynucleotide
cttccrcaagacggccctgttgg

SEQ ID NO: 5076 - DNA, 23 bp, Artificial Sequence
  Synthetic Polynucleotide
ctgrtacatcgatgagccccagg

SEQ ID NO: 5077 - DNA, 23 bp, Artificial Sequence
  Synthetic Polynucleotide
cccaaccctgcaggtcttcygca

SEQ ID NO: 5078 - DNA, 23 bp, Artificial Sequence
  Synthetic Polynucleotide
ccaaccctgcaggtcttcygcaa

SEQ ID NO: 5079 - DNA, 23 bp, Artificial Sequence
  Synthetic Polynucleotide
ccctgcaggtcttcygcaagacg

SEQ ID NO: 5080 - DNA, 23 bp, Artificial Sequence
  Synthetic Polynucleotide
ccttgcctctgtgctagccytgt

SEQ ID NO: 5081 - DNA, 23 bp, Artificial Sequence
  Synthetic Polynucleotide
cctctgtgctagccytgtggatt

SEQ ID NO: 5082 - DNA, 23 bp, Artificial Sequence
  Synthetic Polynucleotide
cctcrtacatctgcacaatttgg

SEQ ID NO: 5083 - DNA, 23 bp, Artificial Sequence
  Synthetic Polynucleotide
ccctcatctacttcacatyggac

SEQ ID NO: 5084 - DNA, 23 bp, Artificial Sequence
  Synthetic Polynucleotide
cctcatctacttcacatyggacc

SEQ ID NO: 5085 - DNA, 23 bp, Artificial Sequence
  Synthetic Polynucleotide
agcagrccctggccgactgccgg

SEQ ID NO: 5086 - DNA, 23 bp, Artificial Sequence
  Synthetic Polynucleotide
tggacraggacgacgacctgtgg

SEQ ID NO: 5087 - DNA, 23 bp, Artificial Sequence
  Synthetic Polynucleotide
gctgtgcrgtatcgggggtaagg

SEQ ID NO: 5088 - DNA, 23 bp, Artificial Sequence
  Synthetic Polynucleotide
cattctargtatgagaccagcgg

SEQ ID NO: 5089 - DNA, 23 bp, Artificial Sequence
  Synthetic Polynucleotide
gactrtatgaagcattaccaagg

SEQ ID NO: 5090 - DNA, 23 bp, Artificial Sequence
  Synthetic Polynucleotide
gaccctttrtgccaccctgaagg

SEQ ID NO: 5091 - DNA, 23 bp, Artificial Sequence
  Synthetic Polynucleotide
ccgtagacaaactctgcygagtg

SEQ ID NO: 5092 - DNA, 23 bp, Artificial Sequence
  Synthetic Polynucleotide
cctacgaggtgaccyaggccaac

SEQ ID NO: 5093 - DNA, 23 bp, Artificial Sequence
  Synthetic Polynucleotide
cgggrgcgcggtggggccggggg

SEQ ID NO: 5094 - DNA, 23 bp, Artificial Sequence
  Synthetic Polynucleotide
ccgggrgcgcggtggggccgggg

SEQ ID NO: 5095 - DNA, 23 bp, Artificial Sequence
  Synthetic Polynucleotide
gccgggrgcgcggtggggccggg

SEQ ID NO: 5096 - DNA, 23 bp, Artificial Sequence
  Synthetic Polynucleotide
ggccgggrgcgcggtggggccgg

SEQ ID NO: 5097 - DNA, 23 bp, Artificial Sequence
  Synthetic Polynucleotide
actrcacttgggcagggaagcgg

SEQ ID NO: 5098 - DNA, 23 bp, Artificial Sequence
  Synthetic Polynucleotide
cccccttctgggaaagacygagt

SEQ ID NO: 5099 - DNA, 23 bp, Artificial Sequence
  Synthetic Polynucleotide
ccccttctgggaaagacygagtg

SEQ ID NO: 5100 - DNA, 23 bp, Artificial Sequence
  Synthetic Polynucleotide
cccttctgggaaagacygagtga

SEQ ID NO: 5101 - DNA, 23 bp, Artificial Sequence
  Synthetic Polynucleotide
ccttctgggaaagacygagtgaa

SEQ ID NO: 5102 - DNA, 23 bp, Artificial Sequence
  Synthetic Polynucleotide
gagrtgttctcagcaatgcctgg

SEQ ID NO: 5103 - DNA, 23 bp, Artificial Sequence
  Synthetic Polynucleotide
cccgcctctccgtctcccyagcg

SEQ ID NO: 5104 - DNA, 23 bp, Artificial Sequence
  Synthetic Polynucleotide
ccgcctctccgtctcccyagcgc

SEQ ID NO: 5105 - DNA, 23 bp, Artificial Sequence
  Synthetic Polynucleotide
cctctccgtctcccyagcgccag

SEQ ID NO: 5106 - DNA, 23 bp, Artificial Sequence
  Synthetic Polynucleotide
ccccccagcgtgttccygaggga

SEQ ID NO: 5107 - DNA, 23 bp, Artificial Sequence
  Synthetic Polynucleotide
cccccagcgtgttccygagggag

SEQ ID NO: 5108 - DNA, 23 bp, Artificial Sequence
  Synthetic Polynucleotide
ccccagcgtgttccygagggagc

SEQ ID NO: 5109 - DNA, 23 bp, Artificial Sequence
  Synthetic Polynucleotide
gtccrgggaacaaatgatgatgg

SEQ ID NO: 5110 - DNA, 23 bp, Artificial Sequence
  Synthetic Polynucleotide
ccacctgtacttaacagtycaca

SEQ ID NO: 5111 - DNA, 23 bp, Artificial Sequence
  Synthetic Polynucleotide
cctgtacttaacagtycacaggg

SEQ ID NO: 5112 - DNA, 23 bp, Artificial Sequence
  Synthetic Polynucleotide
cctgggatttctcctcccyagag

SEQ ID NO: 5113 - DNA, 23 bp, Artificial Sequence
  Synthetic Polynucleotide
ccgcttcaaggcgcgcyagtgca

SEQ ID NO: 5114 - DNA, 23 bp, Artificial Sequence
  Synthetic Polynucleotide
ccagatcgagctgcggyagaaca

SEQ ID NO: 5115 - DNA, 23 bp, Artificial Sequence
  Synthetic Polynucleotide
ccaaggctttgagtctcttygtc

SEQ ID NO: 5116 - DNA, 23 bp, Artificial Sequence
  Synthetic Polynucleotide
gctrttttgggaaacaatcaagg

SEQ ID NO: 5117 - DNA, 23 bp, Artificial Sequence
  Synthetic Polynucleotide
atccrctactctttatttcatgg

SEQ ID NO: 5118 - DNA, 23 bp, Artificial Sequence
  Synthetic Polynucleotide
tcaagtgrggtaagggctgctgg

SEQ ID NO: 5119 - DNA, 23 bp, Artificial Sequence
  Synthetic Polynucleotide
ccatggggactgggtgyatatct

SEQ ID NO: 5120 - DNA, 23 bp, Artificial Sequence
  Synthetic Polynucleotide
ttcrtctgatctcatcagtcagg

SEQ ID NO: 5121 - DNA, 23 bp, Artificial Sequence
  Synthetic Polynucleotide
tgarcaggggccctggagccagg

SEQ ID NO: 5122 - DNA, 23 bp, Artificial Sequence
  Synthetic Polynucleotide
cctggcctttgagtygtcctgca

SEQ ID NO: 5123 - DNA, 23 bp, Artificial Sequence
  Synthetic Polynucleotide
aaaggaaragatggaaggggtgg

SEQ ID NO: 5124 - DNA, 23 bp, Artificial Sequence
  Synthetic Polynucleotide
ccttttaccggtgagyaactact

SEQ ID NO: 5125 - DNA, 23 bp, Artificial Sequence
  Synthetic Polynucleotide
ccgccgccgccgcggagyaggta

SEQ ID NO: 5126 - DNA, 23 bp, Artificial Sequence
  Synthetic Polynucleotide
ccgccgccgcggagyaggtaggg

SEQ ID NO: 5127 - DNA, 23 bp, Artificial Sequence
  Synthetic Polynucleotide
ccctttgccaaaggatttygggg

SEQ ID NO: 5128 - DNA, 23 bp, Artificial Sequence
  Synthetic Polynucleotide
cctttgccaaaggatttyggggc

SEQ ID NO: 5129 - DNA, 23 bp, Artificial Sequence
  Synthetic Polynucleotide
attcacacrggaggcagctcagg

SEQ ID NO: 5130 - DNA, 23 bp, Artificial Sequence
  Synthetic Polynucleotide
ccctggctgatgatgyggatggg

SEQ ID NO: 5131 - DNA, 23 bp, Artificial Sequence
  Synthetic Polynucleotide
cctggctgatgatgyggatgggc

SEQ ID NO: 5132 - DNA, 23 bp, Artificial Sequence
  Synthetic Polynucleotide
ccagctgccctaccagygggtac

SEQ ID NO: 5133 - DNA, 23 bp, Artificial Sequence
  Synthetic Polynucleotide
ttgrtctagaaatggaggacagg

SEQ ID NO: 5134 - DNA, 23 bp, Artificial Sequence
  Synthetic Polynucleotide
gctgtttgrtctagaaatggagg

SEQ ID NO: 5135 - DNA, 23 bp, Artificial Sequence
  Synthetic Polynucleotide
cccgagagcgtctgygggtccgt

SEQ ID NO: 5136 - DNA, 23 bp, Artificial Sequence
  Synthetic Polynucleotide
ccacagcttcctgtcyagtctgc

SEQ ID NO: 5137 - DNA, 23 bp, Artificial Sequence
  Synthetic Polynucleotide
ccgccargcactttggccagagg

SEQ ID NO: 5138 - DNA, 23 bp, Artificial Sequence
  Synthetic Polynucleotide
tgttcrgggatgtgggccacggg

SEQ ID NO: 5139 - DNA, 23 bp, Artificial Sequence
  Synthetic Polynucleotide
atgttcrgggatgtgggccacgg

SEQ ID NO: 5140 - DNA, 23 bp, Artificial Sequence
  Synthetic Polynucleotide
ccccgaggaaggccygagcctcg

SEQ ID NO: 5141 - DNA, 23 bp, Artificial Sequence
  Synthetic Polynucleotide
cagctcgrttttgagagggaggg

SEQ ID NO: 5142 - DNA, 23 bp, Artificial Sequence
  Synthetic Polynucleotide
ccagctcgrttttgagagggagg

SEQ ID NO: 5143 - DNA, 23 bp, Artificial Sequence
  Synthetic Polynucleotide
ccatatctaagtgcaagytcttc

SEQ ID NO: 5144 - DNA, 23 bp, Artificial Sequence
  Synthetic Polynucleotide
ccttcrcaagagccgtgtgctgg

SEQ ID NO: 5145 - DNA, 23 bp, Artificial Sequence
  Synthetic Polynucleotide
catrcagttcgctttcctgttgg

SEQ ID NO: 5146 - DNA, 23 bp, Artificial Sequence
  Synthetic Polynucleotide
gtcagccrcgggtctctcggggg

SEQ ID NO: 5147 - DNA, 23 bp, Artificial Sequence
  Synthetic Polynucleotide
tgtcagccrcgggtctctcgggg

SEQ ID NO: 5148 - DNA, 23 bp, Artificial Sequence
  Synthetic Polynucleotide
cctgggaggggtggtggycattt

SEQ ID NO: 5149 - DNA, 23 bp, Artificial Sequence
  Synthetic Polynucleotide
ccgcrtgggcgacgacgtgctgg

SEQ ID NO: 5150 - DNA, 23 bp, Artificial Sequence
  Synthetic Polynucleotide
cctccrtgagcctgtcctggggg

SEQ ID NO: 5151 - DNA, 23 bp, Artificial Sequence
  Synthetic Polynucleotide
acctccrtgagcctgtcctgggg

SEQ ID NO: 5152 - DNA, 23 bp, Artificial Sequence
  Synthetic Polynucleotide
gacctccrtgagcctgtcctggg

SEQ ID NO: 5153 - DNA, 23 bp, Artificial Sequence
  Synthetic Polynucleotide
tgacctccrtgagcctgtcctgg

SEQ ID NO: 5154 - DNA, 23 bp, Artificial Sequence
  Synthetic Polynucleotide
caccttcrtgctgcgtgtgcggg

SEQ ID NO: 5155 - DNA, 23 bp, Artificial Sequence
  Synthetic Polynucleotide
gcaccttcrtgctgcgtgtgcgg

SEQ ID NO: 5156 - DNA, 23 bp, Artificial Sequence
  Synthetic Polynucleotide
tcacctacrtgccactcctgggg

SEQ ID NO: 5157 - DNA, 23 bp, Artificial Sequence
  Synthetic Polynucleotide
gctgcrgccgattgtgaacatgg

SEQ ID NO: 5158 - DNA, 23 bp, Artificial Sequence
  Synthetic Polynucleotide
tggrcctggacgatatccacagg

SEQ ID NO: 5159 - DNA, 23 bp, Artificial Sequence
  Synthetic Polynucleotide
cagrtgggcctccccggggtcgg

SEQ ID NO: 5160 - DNA, 23 bp, Artificial Sequence
  Synthetic Polynucleotide
ccgccagrtgggcctccccgggg

SEQ ID NO: 5161 - DNA, 23 bp, Artificial Sequence
  Synthetic Polynucleotide
tccgccagrtgggcctccccggg

SEQ ID NO: 5162 - DNA, 23 bp, Artificial Sequence
  Synthetic Polynucleotide
ccaggcacaacgaacgcygcttc

SEQ ID NO: 5163 - DNA, 23 bp, Artificial Sequence
  Synthetic Polynucleotide
cccaggacccgccgyctgagctg

SEQ ID NO: 5164 - DNA, 23 bp, Artificial Sequence
  Synthetic Polynucleotide
cctcttcgacgtcttcctaygct

SEQ ID NO: 5165 - DNA, 23 bp, Artificial Sequence
  Synthetic Polynucleotide
cccagacctgctcgatgaygacg

SEQ ID NO: 5166 - DNA, 23 bp, Artificial Sequence
  Synthetic Polynucleotide
ccagacctgctcgatgaygacgg

SEQ ID NO: 5167 - DNA, 23 bp, Artificial Sequence
  Synthetic Polynucleotide
gcgrcaaggaggacttgatctgg

SEQ ID NO: 5168 - DNA, 23 bp, Artificial Sequence
  Synthetic Polynucleotide
cgaagcgratgctgtgacactgg

SEQ ID NO: 5169 - DNA, 23 bp, Artificial Sequence
  Synthetic Polynucleotide
accrtctaccagcgtgtggaagg

SEQ ID NO: 5170 - DNA, 23 bp, Artificial Sequence
  Synthetic Polynucleotide
tcagaccrtctaccagcgtgtgg

SEQ ID NO: 5171 - DNA, 23 bp, Artificial Sequence
  Synthetic Polynucleotide
ccaagcctgtccagccagyaggc

SEQ ID NO: 5172 - DNA, 23 bp, Artificial Sequence
  Synthetic Polynucleotide
cctgggccccgggccaygactgc

SEQ ID NO: 5173 - DNA, 23 bp, Artificial Sequence
  Synthetic Polynucleotide
agctaccragtgggtgtcttcgg

SEQ ID NO: 5174 - DNA, 23 bp, Artificial Sequence
  Synthetic Polynucleotide
ccagaatggccagtatygagcca

SEQ ID NO: 5175 - DNA, 23 bp, Artificial Sequence
  Synthetic Polynucleotide
agagaacrgagcagactcttggg

SEQ ID NO: 5176 - DNA, 23 bp, Artificial Sequence
  Synthetic Polynucleotide
aagagaacrgagcagactcttgg

SEQ ID NO: 5177 - DNA, 23 bp, Artificial Sequence
  Synthetic Polynucleotide
ccctgccaccaagagaayggagc

SEQ ID NO: 5178 - DNA, 23 bp, Artificial Sequence
  Synthetic Polynucleotide
cctgccaccaagagaayggagca

SEQ ID NO: 5179 - DNA, 23 bp, Artificial Sequence
  Synthetic Polynucleotide
ccattgcttgttcagagaayaat

SEQ ID NO: 5180 - DNA, 23 bp, Artificial Sequence
  Synthetic Polynucleotide
cctctagagaagaacgttygtgg

SEQ ID NO: 5181 - DNA, 23 bp, Artificial Sequence
  Synthetic Polynucleotide
tctcrctgtaatgcagtgggagg

SEQ ID NO: 5182 - DNA, 23 bp, Artificial Sequence
  Synthetic Polynucleotide
acatctcrctgtaatgcagtggg

SEQ ID NO: 5183 - DNA, 23 bp, Artificial Sequence
  Synthetic Polynucleotide
gacatctcrctgtaatgcagtgg

SEQ ID NO: 5184 - DNA, 23 bp, Artificial Sequence
  Synthetic Polynucleotide
cccagtgtgtggcagaaygcttc

SEQ ID NO: 5185 - DNA, 23 bp, Artificial Sequence
  Synthetic Polynucleotide
ccagtgtgtggcagaaygcttca

SEQ ID NO: 5186 - DNA, 23 bp, Artificial Sequence
  Synthetic Polynucleotide
ccacgacccagaggccygtctca

SEQ ID NO: 5187 - DNA, 23 bp, Artificial Sequence
  Synthetic Polynucleotide
tatrtggaggagaaggccatcgg

SEQ ID NO: 5188 - DNA, 23 bp, Artificial Sequence
  Synthetic Polynucleotide
ctcccrggtcatctctgccatgg

SEQ ID NO: 5189 - DNA, 23 bp, Artificial Sequence
  Synthetic Polynucleotide
ggcrtgaccaccacaggtagtgg

SEQ ID NO: 5190 - DNA, 23 bp, Artificial Sequence
  Synthetic Polynucleotide
tacrggaccgaagcacagattgg

SEQ ID NO: 5191 - DNA, 23 bp, Artificial Sequence
  Synthetic Polynucleotide
ggtgagcrgacctggaactacgg

SEQ ID NO: 5192 - DNA, 23 bp, Artificial Sequence
  Synthetic Polynucleotide
ccagtcgtttgtgcctgtgygac

SEQ ID NO: 5193 - DNA, 23 bp, Artificial Sequence
  Synthetic Polynucleotide
cccagtgctgtcattggcygcta

SEQ ID NO: 5194 - DNA, 23 bp, Artificial Sequence
  Synthetic Polynucleotide
ccagtgctgtcattggcygctac

SEQ ID NO: 5195 - DNA, 23 bp, Artificial Sequence
  Synthetic Polynucleotide
ccccttgcagagcgcaygggctt

SEQ ID NO: 5196 - DNA, 23 bp, Artificial Sequence
  Synthetic Polynucleotide
cccttgcagagcgcaygggcttc

SEQ ID NO: 5197 - DNA, 23 bp, Artificial Sequence
  Synthetic Polynucleotide
ccttgcagagcgcaygggcttcc

SEQ ID NO: 5198 - DNA, 23 bp, Artificial Sequence
  Synthetic Polynucleotide
ccaacrcccaaggcagccactgg

SEQ ID NO: 5199 - DNA, 23 bp, Artificial Sequence
  Synthetic Polynucleotide
cagccrcttcctgcacatgaagg

SEQ ID NO: 5200 - DNA, 23 bp, Artificial Sequence
  Synthetic Polynucleotide
cccttcgcgctgctgtgygctat

SEQ ID NO: 5201 - DNA, 23 bp, Artificial Sequence
  Synthetic Polynucleotide
ccttcgcgctgctgtgygctatg

SEQ ID NO: 5202 - DNA, 23 bp, Artificial Sequence
  Synthetic Polynucleotide
ccactggaagcaaaaayggaaat

SEQ ID NO: 5203 - DNA, 23 bp, Artificial Sequence
  Synthetic Polynucleotide
ccagttcatcttgaatygactgg

SEQ ID NO: 5204 - DNA, 23 bp, Artificial Sequence
  Synthetic Polynucleotide
ccagcagctggtgcacyagatga

SEQ ID NO: 5205 - DNA, 23 bp, Artificial Sequence
  Synthetic Polynucleotide
cccctgccaaaagccaagyctgg

SEQ ID NO: 5206 - DNA, 23 bp, Artificial Sequence
  Synthetic Polynucleotide
ccctgccaaaagccaagyctggc

SEQ ID NO: 5207 - DNA, 23 bp, Artificial Sequence
  Synthetic Polynucleotide
cctgccaaaagccaagyctggca

SEQ ID NO: 5208 - DNA, 23 bp, Artificial Sequence
  Synthetic Polynucleotide
ccgacgaagagttcagtccyaat

SEQ ID NO: 5209 - DNA, 23 bp, Artificial Sequence
  Synthetic Polynucleotide
agargttaaagaagagatgcagg

SEQ ID NO: 5210 - DNA, 23 bp, Artificial Sequence
  Synthetic Polynucleotide
ccaagtggagaaatgtcygtggc

SEQ ID NO: 5211 - DNA, 23 bp, Artificial Sequence
  Synthetic Polynucleotide
cctttaggtgtcatctgtayggt

SEQ ID NO: 5212 - DNA, 23 bp, Artificial Sequence
  Synthetic Polynucleotide
cctctcgctggggtcttaygcta

SEQ ID NO: 5213 - DNA, 23 bp, Artificial Sequence
  Synthetic Polynucleotide
cctccataggccgcagcygaggt

SEQ ID NO: 5214 - DNA, 23 bp, Artificial Sequence
  Synthetic Polynucleotide
ccataggccgcagcygaggtgcc

SEQ ID NO: 5215 - DNA, 23 bp, Artificial Sequence
  Synthetic Polynucleotide
actargtaaggaccagagcaagg

SEQ ID NO: 5216 - DNA, 23 bp, Artificial Sequence
  Synthetic Polynucleotide
cctccccacagcagyagtgttgt

SEQ ID NO: 5217 - DNA, 23 bp, Artificial Sequence
  Synthetic Polynucleotide
aaccrcctgaccgtgctggctgg

SEQ ID NO: 5218 - DNA, 23 bp, Artificial Sequence
  Synthetic Polynucleotide
ctataaccrcctgaccgtgctgg

SEQ ID NO: 5219 - DNA, 23 bp, Artificial Sequence
  Synthetic Polynucleotide
ccagcccatgggccaygttgaaa

SEQ ID NO: 5220 - DNA, 23 bp, Artificial Sequence
  Synthetic Polynucleotide
ccgccacagcgtcctccaygagc

SEQ ID NO: 5221 - DNA, 23 bp, Artificial Sequence
  Synthetic Polynucleotide
ccacagcgtcctccaygagctct

SEQ ID NO: 5222 - DNA, 23 bp, Artificial Sequence
  Synthetic Polynucleotide
ccgagaactactttgtgayggac

SEQ ID NO: 5223 - DNA, 23 bp, Artificial Sequence
  Synthetic Polynucleotide
cctgcactgcgccgtgygcgcct

SEQ ID NO: 5224 - DNA, 23 bp, Artificial Sequence
  Synthetic Polynucleotide
ccttctgtgtggccacctygctg

SEQ ID NO: 5225 - DNA, 23 bp, Artificial Sequence
  Synthetic Polynucleotide
cagratggaagaggcgcattggg

SEQ ID NO: 5226 - DNA, 23 bp, Artificial Sequence
  Synthetic Polynucleotide
gcagratggaagaggcgcattgg

SEQ ID NO: 5227 - DNA, 23 bp, Artificial Sequence
  Synthetic Polynucleotide
ccttctctttccctttcyagcag

SEQ ID NO: 5228 - DNA, 23 bp, Artificial Sequence
  Synthetic Polynucleotide
ccggaaggagatcgaagccyggt

SEQ ID NO: 5229 - DNA, 23 bp, Artificial Sequence
  Synthetic Polynucleotide
cctcaaacagtccctygattaat

SEQ ID NO: 5230 - DNA, 23 bp, Artificial Sequence
  Synthetic Polynucleotide
ccggccagcttcataagggygat

SEQ ID NO: 5231 - DNA, 23 bp, Artificial Sequence
  Synthetic Polynucleotide
ccagcttcataagggygatgtca

SEQ ID NO: 5232 - DNA, 23 bp, Artificial Sequence
  Synthetic Polynucleotide
ccacccacccggactggcygatg

SEQ ID NO: 5233 - DNA, 23 bp, Artificial Sequence
  Synthetic Polynucleotide
cccacccggactggcygatgtgc

SEQ ID NO: 5234 - DNA, 23 bp, Artificial Sequence
  Synthetic Polynucleotide
ccacccggactggcygatgtgca

SEQ ID NO: 5235 - DNA, 23 bp, Artificial Sequence
  Synthetic Polynucleotide
cctcaccrggcccggtgtgcggg

SEQ ID NO: 5236 - DNA, 23 bp, Artificial Sequence
  Synthetic Polynucleotide
ccctcaccrggcccggtgtgcgg

SEQ ID NO: 5237 - DNA, 23 bp, Artificial Sequence
  Synthetic Polynucleotide
cagcracgaagagcagtgccagg

SEQ ID NO: 5238 - DNA, 23 bp, Artificial Sequence
  Synthetic Polynucleotide
gacraagagcagtgccaggaagg

SEQ ID NO: 5239 - DNA, 23 bp, Artificial Sequence
  Synthetic Polynucleotide
cagcgacraagagcagtgccagg

SEQ ID NO: 5240 - DNA, 23 bp, Artificial Sequence
  Synthetic Polynucleotide
cctccaggttcggggtygacaca

SEQ ID NO: 5241 - DNA, 23 bp, Artificial Sequence
  Synthetic Polynucleotide
ccagtggctgaaccgcygggcca

SEQ ID NO: 5242 - DNA, 23 bp, Artificial Sequence
  Synthetic Polynucleotide
ctcttcttrcacagtggaccggg

SEQ ID NO: 5243 - DNA, 23 bp, Artificial Sequence
  Synthetic Polynucleotide
accaagtrccacaaaggtagggg

SEQ ID NO: 5244 - DNA, 23 bp, Artificial Sequence
  Synthetic Polynucleotide
taccaagtrccacaaaggtaggg

SEQ ID NO: 5245 - DNA, 23 bp, Artificial Sequence
  Synthetic Polynucleotide
cggacrgcacaccgtgttctggg

SEQ ID NO: 5246 - DNA, 23 bp, Artificial Sequence
  Synthetic Polynucleotide
acggacrgcacaccgtgttctgg

SEQ ID NO: 5247 - DNA, 23 bp, Artificial Sequence
  Synthetic Polynucleotide
ccacaggagcgggacctgygaga

SEQ ID NO: 5248 - DNA, 23 bp, Artificial Sequence
  Synthetic Polynucleotide
cctgcrggcccacctcaagcagg

SEQ ID NO: 5249 - DNA, 23 bp, Artificial Sequence
  Synthetic Polynucleotide
gacaccragaaggtgagtgtggg

SEQ ID NO: 5250 - DNA, 23 bp, Artificial Sequence
  Synthetic Polynucleotide
ggacaccragaaggtgagtgtgg

SEQ ID NO: 5251 - DNA, 23 bp, Artificial Sequence
  Synthetic Polynucleotide
aaaaccrggaggtgggagactgg

SEQ ID NO: 5252 - DNA, 23 bp, Artificial Sequence
  Synthetic Polynucleotide
cctgcggrcccacctcaagcagg

SEQ ID NO: 5253 - DNA, 23 bp, Artificial Sequence
  Synthetic Polynucleotide
accttcraggcaagtttaagcgg

SEQ ID NO: 5254 - DNA, 23 bp, Artificial Sequence
  Synthetic Polynucleotide
cccgggctaaggagtycctggac

SEQ ID NO: 5255 - DNA, 23 bp, Artificial Sequence
  Synthetic Polynucleotide
ccgggctaaggagtycctggacc

SEQ ID NO: 5256 - DNA, 23 bp, Artificial Sequence
  Synthetic Polynucleotide
ccagccccaatcagaygccgctc

SEQ ID NO: 5257 - DNA, 23 bp, Artificial Sequence
  Synthetic Polynucleotide
cgggcgctrgaaatagagcctgg

SEQ ID NO: 5258 - DNA, 23 bp, Artificial Sequence
  Synthetic Polynucleotide
ccaccrgaagcgcatggagaagg

SEQ ID NO: 5259 - DNA, 23 bp, Artificial Sequence
  Synthetic Polynucleotide
gacragaggaggaggagaacagg

SEQ ID NO: 5260 - DNA, 23 bp, Artificial Sequence
  Synthetic Polynucleotide
catccrgaatgagcgggagaagg

SEQ ID NO: 5261 - DNA, 23 bp, Artificial Sequence
  Synthetic Polynucleotide
cccctgcagctccaagaccygcg

SEQ ID NO: 5262 - DNA, 23 bp, Artificial Sequence
  Synthetic Polynucleotide
ccctgcagctccaagaccygcgg

SEQ ID NO: 5263 - DNA, 23 bp, Artificial Sequence
  Synthetic Polynucleotide
cctgcagctccaagaccygcggg

SEQ ID NO: 5264 - DNA, 23 bp, Artificial Sequence
  Synthetic Polynucleotide
ccacccacaggacatccacygga

SEQ ID NO: 5265 - DNA, 23 bp, Artificial Sequence
  Synthetic Polynucleotide
cccacaggacatccacyggaagc

SEQ ID NO: 5266 - DNA, 23 bp, Artificial Sequence
  Synthetic Polynucleotide
ccacaggacatccacyggaagcg

SEQ ID NO: 5267 - DNA, 23 bp, Artificial Sequence
  Synthetic Polynucleotide
cctgaatgagttgcaggygctga

SEQ ID NO: 5268 - DNA, 23 bp, Artificial Sequence
  Synthetic Polynucleotide
ccttaggagagacgtygggcaga

SEQ ID NO: 5269 - DNA, 23 bp, Artificial Sequence
  Synthetic Polynucleotide
catgcggcrctggaacacctggg

SEQ ID NO: 5270 - DNA, 23 bp, Artificial Sequence
  Synthetic Polynucleotide
cctgccacgaagccygtagaggt

SEQ ID NO: 5271 - DNA, 23 bp, Artificial Sequence
  Synthetic Polynucleotide
acactgraagactccaggtcagg

SEQ ID NO: 5272 - DNA, 23 bp, Artificial Sequence
  Synthetic Polynucleotide
cacttttcracatagtgtggtgg

SEQ ID NO: 5273 - DNA, 23 bp, Artificial Sequence
  Synthetic Polynucleotide
gacctrccctgtgcagctgtggg

SEQ ID NO: 5274 - DNA, 23 bp, Artificial Sequence
  Synthetic Polynucleotide
agacctrccctgtgcagctgtgg

SEQ ID NO: 5275 - DNA, 23 bp, Artificial Sequence
  Synthetic Polynucleotide
cccccagggagcactaagygagg

SEQ ID NO: 5276 - DNA, 23 bp, Artificial Sequence
  Synthetic Polynucleotide
ccccagggagcactaagygaggt

SEQ ID NO: 5277 - DNA, 23 bp, Artificial Sequence
  Synthetic Polynucleotide
cccagggagcactaagygaggta

SEQ ID NO: 5278 - DNA, 23 bp, Artificial Sequence
  Synthetic Polynucleotide
ccagggagcactaagygaggtaa

SEQ ID NO: 5279 - DNA, 23 bp, Artificial Sequence
  Synthetic Polynucleotide
ccctcctcagcatcttatcygag

SEQ ID NO: 5280 - DNA, 23 bp, Artificial Sequence
  Synthetic Polynucleotide
cctcctcagcatcttatcygagt

SEQ ID NO: 5281 - DNA, 23 bp, Artificial Sequence
  Synthetic Polynucleotide
cctcagcatcttatcygagtgga

SEQ ID NO: 5282 - DNA, 23 bp, Artificial Sequence
  Synthetic Polynucleotide
cccctcctcagcatyttatccga

SEQ ID NO: 5283 - DNA, 23 bp, Artificial Sequence
  Synthetic Polynucleotide
ccatggccatctacaagyagtca

SEQ ID NO: 5284 - DNA, 23 bp, Artificial Sequence
  Synthetic Polynucleotide
gcccrgatctgtgcttgcccagg

SEQ ID NO: 5285 - DNA, 23 bp, Artificial Sequence
  Synthetic Polynucleotide
gccracgctgctttgaggcccgg

SEQ ID NO: 5286 - DNA, 23 bp, Artificial Sequence
  Synthetic Polynucleotide
cctgggccracgctgctttgagg

SEQ ID NO: 5287 - DNA, 23 bp, Artificial Sequence
  Synthetic Polynucleotide
ctcrgagtaatcgcctgcattgg

SEQ ID NO: 5288 - DNA, 23 bp, Artificial Sequence
  Synthetic Polynucleotide
gagcracctggaacgtgcagagg

SEQ ID NO: 5289 - DNA, 23 bp, Artificial Sequence
  Synthetic Polynucleotide
ggatcgarctgagcaggcggagg

SEQ ID NO: 5290 - DNA, 23 bp, Artificial Sequence
  Synthetic Polynucleotide
cctttccracaagctgaaggagg

SEQ ID NO: 5291 - DNA, 23 bp, Artificial Sequence
  Synthetic Polynucleotide
tgctragtttgctgagagatcgg

SEQ ID NO: 5292 - DNA, 23 bp, Artificial Sequence
  Synthetic Polynucleotide
ccactgctcatgatggaggycat

SEQ ID NO: 5293 - DNA, 23 bp, Artificial Sequence
  Synthetic Polynucleotide
tacrgtgccttttgggactgagg

SEQ ID NO: 5294 - DNA, 23 bp, Artificial Sequence
  Synthetic Polynucleotide
gccgggtrttggtctgtctctgg

SEQ ID NO: 5295 - DNA, 23 bp, Artificial Sequence
  Synthetic Polynucleotide
tggccrtgcctacccagatgtgg

SEQ ID NO: 5296 - DNA, 23 bp, Artificial Sequence
  Synthetic Polynucleotide
cccctctgtgatccgtaagygat

SEQ ID NO: 5297 - DNA, 23 bp, Artificial Sequence
  Synthetic Polynucleotide
ccctctgtgatccgtaagygata

SEQ ID NO: 5298 - DNA, 23 bp, Artificial Sequence
  Synthetic Polynucleotide
cctctgtgatccgtaagygatac

SEQ ID NO: 5299 - DNA, 23 bp, Artificial Sequence
  Synthetic Polynucleotide
ccccctctgtgatcygtaagcga

SEQ ID NO: 5300 - DNA, 23 bp, Artificial Sequence
  Synthetic Polynucleotide
actgrgggaggcgcaaggcctgg

SEQ ID NO: 5301 - DNA, 23 bp, Artificial Sequence
  Synthetic Polynucleotide
tttttcracatggaggccactgg

SEQ ID NO: 5302 - DNA, 23 bp, Artificial Sequence
  Synthetic Polynucleotide
ccaaacacagcttcagccaygag

SEQ ID NO: 5303 - DNA, 23 bp, Artificial Sequence
  Synthetic Polynucleotide
ccccagaacatcctgtgccyagc

SEQ ID NO: 5304 - DNA, 23 bp, Artificial Sequence
  Synthetic Polynucleotide
cccagaacatcctgtgccyagcg

SEQ ID NO: 5305 - DNA, 23 bp, Artificial Sequence
  Synthetic Polynucleotide
ccagaacatcctgtgccyagcgg

SEQ ID NO: 5306 - DNA, 23 bp, Artificial Sequence
  Synthetic Polynucleotide
cctcatccacccaayaggaaatc

SEQ ID NO: 5307 - DNA, 23 bp, Artificial Sequence
  Synthetic Polynucleotide
cctgtgtgtattgggtacygaga

SEQ ID NO: 5308 - DNA, 23 bp, Artificial Sequence
  Synthetic Polynucleotide
cccaatagagccacaygagacaa

SEQ ID NO: 5309 - DNA, 23 bp, Artificial Sequence
  Synthetic Polynucleotide
ccaatagagccacaygagacaac

SEQ ID NO: 5310 - DNA, 23 bp, Artificial Sequence
  Synthetic Polynucleotide
taggtgrcctgagagagccctgg

SEQ ID NO: 5311 - DNA, 23 bp, Artificial Sequence
  Synthetic Polynucleotide
tttcrggccagtttccaagaggg

SEQ ID NO: 5312 - DNA, 23 bp, Artificial Sequence
  Synthetic Polynucleotide
gtttcrggccagtttccaagagg

SEQ ID NO: 5313 - DNA, 23 bp, Artificial Sequence
  Synthetic Polynucleotide
tggacrccctgctgaatgaccgg

SEQ ID NO: 5314 - DNA, 23 bp, Artificial Sequence
  Synthetic Polynucleotide
gagaagragcaggtgagcgccgg

SEQ ID NO: 5315 - DNA, 23 bp, Artificial Sequence
  Synthetic Polynucleotide
cccaagcttgtgatctyagtcca

SEQ ID NO: 5316 - DNA, 23 bp, Artificial Sequence
  Synthetic Polynucleotide
ccaagcttgtgatctyagtccat

SEQ ID NO: 5317 - DNA, 23 bp, Artificial Sequence
  Synthetic Polynucleotide
aagaaagcrccttaacccagagg

SEQ ID NO: 5318 - DNA, 23 bp, Artificial Sequence
  Synthetic Polynucleotide
tggcraaagaatgcaaatggcgg

SEQ ID NO: 5319 - DNA, 23 bp, Artificial Sequence
  Synthetic Polynucleotide
ctctggcraaagaatgcaaatgg

SEQ ID NO: 5320 - DNA, 23 bp, Artificial Sequence
  Synthetic Polynucleotide
ccgcccatctggcgygacctatt

SEQ ID NO: 5321 - DNA, 23 bp, Artificial Sequence
  Synthetic Polynucleotide
ttcraggtgagccacccagatgg

SEQ ID NO: 5322 - DNA, 23 bp, Artificial Sequence
  Synthetic Polynucleotide
cccrtgggctgaagctgacgggg

SEQ ID NO: 5323 - DNA, 23 bp, Artificial Sequence
  Synthetic Polynucleotide
acccrtgggctgaagctgacggg

SEQ ID NO: 5324 - DNA, 23 bp, Artificial Sequence
  Synthetic Polynucleotide
cacccrtgggctgaagctgacgg

SEQ ID NO: 5325 - DNA, 23 bp, Artificial Sequence
  Synthetic Polynucleotide
atgcggcrccaggactcgcgagg

SEQ ID NO: 5326 - DNA, 23 bp, Artificial Sequence
  Synthetic Polynucleotide
ccacaagaaggcggacatgyggc

SEQ ID NO: 5327 - DNA, 23 bp, Artificial Sequence
  Synthetic Polynucleotide
ccccgcagtgggccaccaycatc

SEQ ID NO: 5328 - DNA, 23 bp, Artificial Sequence
  Synthetic Polynucleotide
cccgcagtgggccaccaycatcc

SEQ ID NO: 5329 - DNA, 23 bp, Artificial Sequence
  Synthetic Polynucleotide
ccgcagtgggccaccaycatcct

SEQ ID NO: 5330 - DNA, 23 bp, Artificial Sequence
  Synthetic Polynucleotide
tcatrgtgcctgaagaaaccagg

SEQ ID NO: 5331 - DNA, 23 bp, Artificial Sequence
  Synthetic Polynucleotide
ccaatgatggagcatgtgygaat

SEQ ID NO: 5332 - DNA, 23 bp, Artificial Sequence
  Synthetic Polynucleotide
gcatccrgctgcaggtatggtgg

SEQ ID NO: 5333 - DNA, 23 bp, Artificial Sequence
  Synthetic Polynucleotide
cggctrgattcagaacctgcagg

SEQ ID NO: 5334 - DNA, 23 bp, Artificial Sequence
  Synthetic Polynucleotide
gctggccrggctcgtgttccagg

SEQ ID NO: 5335 - DNA, 23 bp, Artificial Sequence
  Synthetic Polynucleotide
acagrtgagtgtggtgggtgggg

SEQ ID NO: 5336 - DNA, 23 bp, Artificial Sequence
  Synthetic Polynucleotide
gacagrtgagtgtggtgggtggg

SEQ ID NO: 5337 - DNA, 23 bp, Artificial Sequence
  Synthetic Polynucleotide
ggacagrtgagtgtggtgggtgg

SEQ ID NO: 5338 - DNA, 23 bp, Artificial Sequence
  Synthetic Polynucleotide
ccacgtgatcgtcacccygctgg

SEQ ID NO: 5339 - DNA, 23 bp, Artificial Sequence
  Synthetic Polynucleotide
cccagtggcctccggcccygagg

SEQ ID NO: 5340 - DNA, 23 bp, Artificial Sequence
  Synthetic Polynucleotide
ccagtggcctccggcccygaggt

SEQ ID NO: 5341 - DNA, 23 bp, Artificial Sequence
  Synthetic Polynucleotide
cccagaggagaaacccyaggagt

SEQ ID NO: 5342 - DNA, 23 bp, Artificial Sequence
  Synthetic Polynucleotide
ccagaggagaaacccyaggagtc

SEQ ID NO: 5343 - DNA, 23 bp, Artificial Sequence
  Synthetic Polynucleotide
tgaatrtggagaaggtgaagagg

SEQ ID NO: 5344 - DNA, 23 bp, Artificial Sequence
  Synthetic Polynucleotide
tgctrgatattgtatgacacggg

SEQ ID NO: 5345 - DNA, 23 bp, Artificial Sequence
  Synthetic Polynucleotide
gtgctrgatattgtatgacacgg

SEQ ID NO: 5346 - DNA, 23 bp, Artificial Sequence
  Synthetic Polynucleotide
cccaaatatgctctgtccyagga

SEQ ID NO: 5347 - DNA, 23 bp, Artificial Sequence
  Synthetic Polynucleotide
ccaaatatgctctgtccyaggat

SEQ ID NO: 5348 - DNA, 23 bp, Artificial Sequence
  Synthetic Polynucleotide
cctctgtagacctctacaytcac

SEQ ID NO: 5349 - DNA, 23 bp, Artificial Sequence
  Synthetic Polynucleotide
ccttggagggggcatgaagyagg

SEQ ID NO: 5350 - DNA, 23 bp, Artificial Sequence
  Synthetic Polynucleotide
ccccacacagggctcagyagctg

SEQ ID NO: 5351 - DNA, 23 bp, Artificial Sequence
  Synthetic Polynucleotide
cccacacagggctcagyagctgg

SEQ ID NO: 5352 - DNA, 23 bp, Artificial Sequence
  Synthetic Polynucleotide
ccacacagggctcagyagctggc

SEQ ID NO: 5353 - DNA, 23 bp, Artificial Sequence
  Synthetic Polynucleotide
ctgccragccagctgtgctttgg

SEQ ID NO: 5354 - DNA, 23 bp, Artificial Sequence
  Synthetic Polynucleotide
gctcrctcaatgattttggcagg

SEQ ID NO: 5355 - DNA, 23 bp, Artificial Sequence
  Synthetic Polynucleotide
ttctgctcrctcaatgattttgg

SEQ ID NO: 5356 - DNA, 23 bp, Artificial Sequence
  Synthetic Polynucleotide
atccragcttattgtacaggagg

SEQ ID NO: 5357 - DNA, 23 bp, Artificial Sequence
  Synthetic Polynucleotide
cacatccragcttattgtacagg

SEQ ID NO: 5358 - DNA, 23 bp, Artificial Sequence
  Synthetic Polynucleotide
ggctgtcrtcaccaatcccaagg

SEQ ID NO: 5359 - DNA, 23 bp, Artificial Sequence
  Synthetic Polynucleotide
actraggaggaatttgtagaagg

SEQ ID NO: 5360 - DNA, 23 bp, Artificial Sequence
  Synthetic Polynucleotide
cccaacrtaccagtgaacaaagg

SEQ ID NO: 5361 - DNA, 23 bp, Artificial Sequence
  Synthetic Polynucleotide
cctggtgccctatcccygcatcc

SEQ ID NO: 5362 - DNA, 23 bp, Artificial Sequence
  Synthetic Polynucleotide
gtgcactrgtatgtgggtgaggg

SEQ ID NO: 5363 - DNA, 23 bp, Artificial Sequence
  Synthetic Polynucleotide
tgtgcactrgtatgtgggtgagg

SEQ ID NO: 5364 - DNA, 23 bp, Artificial Sequence
  Synthetic Polynucleotide
cccaggcctcggcgatggyggtc

SEQ ID NO: 5365 - DNA, 23 bp, Artificial Sequence
  Synthetic Polynucleotide
ccaggcctcggcgatggyggtcg

SEQ ID NO: 5366 - DNA, 23 bp, Artificial Sequence
  Synthetic Polynucleotide
cctgctgcctgctgtacygtgga

SEQ ID NO: 5367 - DNA, 23 bp, Artificial Sequence
  Synthetic Polynucleotide
aggcragggcatggacgagatgg

SEQ ID NO: 5368 - DNA, 23 bp, Artificial Sequence
  Synthetic Polynucleotide
ggtctrcgttcagctggcccggg

SEQ ID NO: 5369 - DNA, 23 bp, Artificial Sequence
  Synthetic Polynucleotide
aggtctrcgttcagctggcccgg

SEQ ID NO: 5370 - DNA, 23 bp, Artificial Sequence
  Synthetic Polynucleotide
gtccragtaccagcagtaccagg

SEQ ID NO: 5371 - DNA, 23 bp, Artificial Sequence
  Synthetic Polynucleotide
gccrcctgcgacccgcgccacgg

SEQ ID NO: 5372 - DNA, 23 bp, Artificial Sequence
  Synthetic Polynucleotide
gaacgccracctgcgcaagctgg

SEQ ID NO: 5373 - DNA, 23 bp, Artificial Sequence
  Synthetic Polynucleotide
ccccggctggtcaggggtgygaa

SEQ ID NO: 5374 - DNA, 23 bp, Artificial Sequence
  Synthetic Polynucleotide
cccggctggtcaggggtgygaag

SEQ ID NO: 5375 - DNA, 23 bp, Artificial Sequence
  Synthetic Polynucleotide
ccggctggtcaggggtgygaagc

SEQ ID NO: 5376 - DNA, 23 bp, Artificial Sequence
  Synthetic Polynucleotide
cttgcggcrgggcctggtcatgg

SEQ ID NO: 5377 - DNA, 23 bp, Artificial Sequence
  Synthetic Polynucleotide
ccctcaacttccaaggcygggtc

SEQ ID NO: 5378 - DNA, 23 bp, Artificial Sequence
  Synthetic Polynucleotide
cctcaacttccaaggcygggtca

SEQ ID NO: 5379 - DNA, 23 bp, Artificial Sequence
  Synthetic Polynucleotide
gctacrccttctcggtctggagg

SEQ ID NO: 5380 - DNA, 23 bp, Artificial Sequence
  Synthetic Polynucleotide
tcagctacrccttctcggtctgg

SEQ ID NO: 5381 - DNA, 23 bp, Artificial Sequence
  Synthetic Polynucleotide
ccgggcagcccggccyagggcaa

SEQ ID NO: 5382 - DNA, 23 bp, Artificial Sequence
  Synthetic Polynucleotide
ccttcgaggagctgyagagccag

SEQ ID NO: 5383 - DNA, 23 bp, Artificial Sequence
  Synthetic Polynucleotide
cctgcacaacggctggyaggtgg

SEQ ID NO: 5384 - DNA, 23 bp, Artificial Sequence
  Synthetic Polynucleotide
tgatcagcrgacgtggtctgggg

SEQ ID NO: 5385 - DNA, 23 bp, Artificial Sequence
  Synthetic Polynucleotide
aggargcaccttggataagctgg

SEQ ID NO: 5386 - DNA, 23 bp, Artificial Sequence
  Synthetic Polynucleotide
aagcaccarcttttctgccttgg

SEQ ID NO: 5387 - DNA, 23 bp, Artificial Sequence
  Synthetic Polynucleotide
tgtgrccagctttcaggcagagg

SEQ ID NO: 5388 - DNA, 23 bp, Artificial Sequence
  Synthetic Polynucleotide
cagtrctctggcaacttcatggg

SEQ ID NO: 5389 - DNA, 23 bp, Artificial Sequence
  Synthetic Polynucleotide
ccagtrctctggcaacttcatgg

SEQ ID NO: 5390 - DNA, 23 bp, Artificial Sequence
  Synthetic Polynucleotide
ccgggagtcgtggcyttccgtct

SEQ ID NO: 5391 - DNA, 23 bp, Artificial Sequence
  Synthetic Polynucleotide
cctccgctggccatttcyctaga

SEQ ID NO: 5392 - DNA, 23 bp, Artificial Sequence
  Synthetic Polynucleotide
ccgctggccatttcyctagagcc

SEQ ID NO: 5393 - DNA, 23 bp, Artificial Sequence
  Synthetic Polynucleotide
ccgaaggcaccgtcytcttcaag

SEQ ID NO: 5394 - DNA, 23 bp, Artificial Sequence
  Synthetic Polynucleotide
ccaatgccctggacaaygtggat

SEQ ID NO: 5395 - DNA, 23 bp, Artificial Sequence
  Synthetic Polynucleotide
ccctgtaggcccagtcaccycca

SEQ ID NO: 5396 - DNA, 23 bp, Artificial Sequence
  Synthetic Polynucleotide
cctgtaggcccagtcaccyccat

SEQ ID NO: 5397 - DNA, 23 bp, Artificial Sequence
  Synthetic Polynucleotide
ccctatagtcccttttaccycca

SEQ ID NO: 5398 - DNA, 23 bp, Artificial Sequence
  Synthetic Polynucleotide
cctatagtcccttttaccyccat

SEQ ID NO: 5399 - DNA, 23 bp, Artificial Sequence
  Synthetic Polynucleotide
ccatcctgaccatggtgyggact

SEQ ID NO: 5400 - DNA, 23 bp, Artificial Sequence
  Synthetic Polynucleotide
tggcactrtgagtgctccccggg

SEQ ID NO: 5401 - DNA, 23 bp, Artificial Sequence
  Synthetic Polynucleotide
atggcactrtgagtgctccccgg

SEQ ID NO: 5402 - DNA, 23 bp, Artificial Sequence
  Synthetic Polynucleotide
atggcactrccagtgcaaacagg

SEQ ID NO: 5403 - DNA, 23 bp, Artificial Sequence
  Synthetic Polynucleotide
ccccagcgcgagtaccatayctg

SEQ ID NO: 5404 - DNA, 23 bp, Artificial Sequence
  Synthetic Polynucleotide
cccagcgcgagtaccatayctgc

SEQ ID NO: 5405 - DNA, 23 bp, Artificial Sequence
  Synthetic Polynucleotide
ccagcgcgagtaccatayctgca

SEQ ID NO: 5406 - DNA, 23 bp, Artificial Sequence
  Synthetic Polynucleotide
ccgcattcgggagtytttctttc

SEQ ID NO: 5407 - DNA, 23 bp, Artificial Sequence
  Synthetic Polynucleotide
ccagggatttgggcctttcygct

SEQ ID NO: 5408 - DNA, 23 bp, Artificial Sequence
  Synthetic Polynucleotide
catcrctacattgccaacctggg

SEQ ID NO: 5409 - DNA, 23 bp, Artificial Sequence
  Synthetic Polynucleotide
acatcrctacattgccaacctgg

SEQ ID NO: 5410 - DNA, 23 bp, Artificial Sequence
  Synthetic Polynucleotide
ccattaagagaagagyaggacct

SEQ ID NO: 5411 - DNA, 23 bp, Artificial Sequence
  Synthetic Polynucleotide
ccagctgcttcgcatcytcactg

SEQ ID NO: 5412 - DNA, 23 bp, Artificial Sequence
  Synthetic Polynucleotide
cttgrccttatcagtgacagggg

SEQ ID NO: 5413 - DNA, 23 bp, Artificial Sequence
  Synthetic Polynucleotide
tcttgrccttatcagtgacaggg

SEQ ID NO: 5414 - DNA, 23 bp, Artificial Sequence
  Synthetic Polynucleotide
ttcttgrccttatcagtgacagg

SEQ ID NO: 5415 - DNA, 23 bp, Artificial Sequence
  Synthetic Polynucleotide
ccatcggccccactayggctcgc

SEQ ID NO: 5416 - DNA, 23 bp, Artificial Sequence
  Synthetic Polynucleotide
ccaggcaataatgaaggttyttt

SEQ ID NO: 5417 - DNA, 23 bp, Artificial Sequence
  Synthetic Polynucleotide
actctctrggctgcctaccatgg

SEQ ID NO: 5418 - DNA, 23 bp, Artificial Sequence
  Synthetic Polynucleotide
tcagrtaatgagaaacgataagg

SEQ ID NO: 5419 - DNA, 23 bp, Artificial Sequence
  Synthetic Polynucleotide
ctcctrgaacccacccaaaaagg

SEQ ID NO: 5420 - DNA, 23 bp, Artificial Sequence
  Synthetic Polynucleotide
tactrcattcctaatgatgcagg

SEQ ID NO: 5421 - DNA, 23 bp, Artificial Sequence
  Synthetic Polynucleotide
ctcrgtactgaggcactgtgggg

SEQ ID NO: 5422 - DNA, 23 bp, Artificial Sequence
  Synthetic Polynucleotide
gctcrgtactgaggcactgtggg

SEQ ID NO: 5423 - DNA, 23 bp, Artificial Sequence
  Synthetic Polynucleotide
ggctcrgtactgaggcactgtgg

SEQ ID NO: 5424 - DNA, 23 bp, Artificial Sequence
  Synthetic Polynucleotide
cctggatcccaccagaayagtct

SEQ ID NO: 5425 - DNA, 23 bp, Artificial Sequence
  Synthetic Polynucleotide
ccctcgaagcatctgygaatcac

SEQ ID NO: 5426 - DNA, 23 bp, Artificial Sequence
  Synthetic Polynucleotide
cctcgaagcatctgygaatcact

SEQ ID NO: 5427 - DNA, 23 bp, Artificial Sequence
  Synthetic Polynucleotide
ccatgtgatctcttctaccyaag

SEQ ID NO: 5428 - DNA, 23 bp, Artificial Sequence
  Synthetic Polynucleotide
ccatcrtcctgctggagctcagg

SEQ ID NO: 5429 - DNA, 23 bp, Artificial Sequence
  Synthetic Polynucleotide
ggacaaccracgccactgccagg

SEQ ID NO: 5430 - DNA, 23 bp, Artificial Sequence
  Synthetic Polynucleotide
ctgccrgctcaaacgctgtgtgg

SEQ ID NO: 5431 - DNA, 23 bp, Artificial Sequence
  Synthetic Polynucleotide
caggcraagcatgaagcggaagg

SEQ ID NO: 5432 - DNA, 23 bp, Artificial Sequence
  Synthetic Polynucleotide
ggagragcatgtcctgctcatgg

SEQ ID NO: 5433 - DNA, 23 bp, Artificial Sequence
  Synthetic Polynucleotide
cctactccgacttctgcyagttc

SEQ ID NO: 5434 - DNA, 23 bp, Artificial Sequence
  Synthetic Polynucleotide
ccagaagctagccgacctgygca

SEQ ID NO: 5435 - DNA, 23 bp, Artificial Sequence
  Synthetic Polynucleotide
gcatcrgcaggaagtgtgattgg

SEQ ID NO: 5436 - DNA, 23 bp, Artificial Sequence
  Synthetic Polynucleotide
agcratgcctccaggttgtccgg

SEQ ID NO: 5437 - DNA, 23 bp, Artificial Sequence
  Synthetic Polynucleotide
ccgcgcgtcgtgctgcycgtatg

SEQ ID NO: 5438 - DNA, 23 bp, Artificial Sequence
  Synthetic Polynucleotide
cctgtcrcacctccagctctcgg

SEQ ID NO: 5439 - DNA, 23 bp, Artificial Sequence
  Synthetic Polynucleotide
tactacagrtctgtgggtattgg

SEQ ID NO: 5440 - DNA, 23 bp, Artificial Sequence
  Synthetic Polynucleotide
cctttgccatccattygaatatt

SEQ ID NO: 5441 - DNA, 23 bp, Artificial Sequence
  Synthetic Polynucleotide
ccaaacagaaattgccttygtac

SEQ ID NO: 5442 - DNA, 23 bp, Artificial Sequence
  Synthetic Polynucleotide
cccaggtgctagagcggygaagc

SEQ ID NO: 5443 - DNA, 23 bp, Artificial Sequence
  Synthetic Polynucleotide
ccaggtgctagagcggygaagct

SEQ ID NO: 5444 - DNA, 23 bp, Artificial Sequence
  Synthetic Polynucleotide
gacrgctcccacgcctacatcgg

SEQ ID NO: 5445 - DNA, 23 bp, Artificial Sequence
  Synthetic Polynucleotide
cctgctggatggctyctccaggc

SEQ ID NO: 5446 - DNA, 23 bp, Artificial Sequence
  Synthetic Polynucleotide
cctcatcaatgagtgtgtcygag

SEQ ID NO: 5447 - DNA, 23 bp, Artificial Sequence
  Synthetic Polynucleotide
cctgctttcctctcccagaygct

SEQ ID NO: 5448 - DNA, 23 bp, Artificial Sequence
  Synthetic Polynucleotide
ccagagctcatttacycgcaatg

SEQ ID NO: 5449 - DNA, 23 bp, Artificial Sequence
  Synthetic Polynucleotide
gatcragggaatggtcaggtagg

SEQ ID NO: 5450 - DNA, 23 bp, Artificial Sequence
  Synthetic Polynucleotide
agaagatcragggaatggtcagg

SEQ ID NO: 5451 - DNA, 23 bp, Artificial Sequence
  Synthetic Polynucleotide
cccagctgatcttgaatttyagc

SEQ ID NO: 5452 - DNA, 23 bp, Artificial Sequence
  Synthetic Polynucleotide
ccagctgatcttgaatttyagca

SEQ ID NO: 5453 - DNA, 23 bp, Artificial Sequence
  Synthetic Polynucleotide
cttrggctggcgggtagcccagg

SEQ ID NO: 5454 - DNA, 23 bp, Artificial Sequence
  Synthetic Polynucleotide
acatcraggaagttttggcaagg

SEQ ID NO: 5455 - DNA, 23 bp, Artificial Sequence
  Synthetic Polynucleotide
cgccagrtaggctgaggcctggg

SEQ ID NO: 5456 - DNA, 23 bp, Artificial Sequence
  Synthetic Polynucleotide
ccgccagrtaggctgaggcctgg

SEQ ID NO: 5457 - DNA, 23 bp, Artificial Sequence
  Synthetic Polynucleotide
caccattcrcttctggaacttgg

SEQ ID NO: 5458 - DNA, 23 bp, Artificial Sequence
  Synthetic Polynucleotide
caggtgtrggtggtgaccaaagg

SEQ ID NO: 5459 - DNA, 23 bp, Artificial Sequence
  Synthetic Polynucleotide
cctgtctcccagggcctgcyccc

SEQ ID NO: 5460 - DNA, 23 bp, Artificial Sequence
  Synthetic Polynucleotide
aggrccgcctgggcagcaagtgg

SEQ ID NO: 5461 - DNA, 23 bp, Artificial Sequence
  Synthetic Polynucleotide
gtgrgcatgccattcagcagcgg

SEQ ID NO: 5462 - DNA, 23 bp, Artificial Sequence
  Synthetic Polynucleotide
cccaagtccctgcagaagyagag

SEQ ID NO: 5463 - DNA, 23 bp, Artificial Sequence
  Synthetic Polynucleotide
ccaagtccctgcagaagyagagg

SEQ ID NO: 5464 - DNA, 23 bp, Artificial Sequence
  Synthetic Polynucleotide
ccatcaacatgctccygttcttc

SEQ ID NO: 5465 - DNA, 23 bp, Artificial Sequence
  Synthetic Polynucleotide
cctcaacgtcagcgtccygtgcc

SEQ ID NO: 5466 - DNA, 23 bp, Artificial Sequence
  Synthetic Polynucleotide
ctctrtgtgagtggggccattgg

SEQ ID NO: 5467 - DNA, 23 bp, Artificial Sequence
  Synthetic Polynucleotide
cctcagcgtgtttacygaaatcg

SEQ ID NO: 5468 - DNA, 23 bp, Artificial Sequence
  Synthetic Polynucleotide
cccaaactcaccacttcyaaccc

SEQ ID NO: 5469 - DNA, 23 bp, Artificial Sequence
  Synthetic Polynucleotide
ccaaactcaccacttcyaacccc

SEQ ID NO: 5470 - DNA, 23 bp, Artificial Sequence
  Synthetic Polynucleotide
cagccccracatgggcttcgggg

SEQ ID NO: 5471 - DNA, 23 bp, Artificial Sequence
  Synthetic Polynucleotide
gcagccccracatgggcttcggg

SEQ ID NO: 5472 - DNA, 23 bp, Artificial Sequence
  Synthetic Polynucleotide
ggcrgctgcagccccgacatggg

SEQ ID NO: 5473 - DNA, 23 bp, Artificial Sequence
  Synthetic Polynucleotide
gggcrgctgcagccccgacatgg

SEQ ID NO: 5474 - DNA, 23 bp, Artificial Sequence
  Synthetic Polynucleotide
ccaggagtgccagcacyagttcc

SEQ ID NO: 5475 - DNA, 23 bp, Artificial Sequence
  Synthetic Polynucleotide
cctctctrcagccaactggcagg

SEQ ID NO: 5476 - DNA, 23 bp, Artificial Sequence
  Synthetic Polynucleotide
acctacrccatcattgccgccgg

SEQ ID NO: 5477 - DNA, 23 bp, Artificial Sequence
  Synthetic Polynucleotide
ccacactgccacagtttygggag

SEQ ID NO: 5478 - DNA, 23 bp, Artificial Sequence
  Synthetic Polynucleotide
gagcrgggctgtctctgtgtggg

SEQ ID NO: 5479 - DNA, 23 bp, Artificial Sequence
  Synthetic Polynucleotide
cgagcrgggctgtctctgtgtgg

SEQ ID NO: 5480 - DNA, 23 bp, Artificial Sequence
  Synthetic Polynucleotide
cctgtgctgggatctcyggcagt

SEQ ID NO: 5481 - DNA, 23 bp, Artificial Sequence
  Synthetic Polynucleotide
cccacctctgctttyatcccgat

SEQ ID NO: 5482 - DNA, 23 bp, Artificial Sequence
  Synthetic Polynucleotide
cccccttgatttggagygagcag

SEQ ID NO: 5483 - DNA, 23 bp, Artificial Sequence
  Synthetic Polynucleotide
ccccttgatttggagygagcagg

SEQ ID NO: 5484 - DNA, 23 bp, Artificial Sequence
  Synthetic Polynucleotide
cccttgatttggagygagcaggc

SEQ ID NO: 5485 - DNA, 23 bp, Artificial Sequence
  Synthetic Polynucleotide
ccagtgtaaaacttgtcagygaa

SEQ ID NO: 5486 - DNA, 23 bp, Artificial Sequence
  Synthetic Polynucleotide
cccacaggaaatctgtgcygctg

SEQ ID NO: 5487 - DNA, 23 bp, Artificial Sequence
  Synthetic Polynucleotide
ccacaggaaatctgtgcygctgc

SEQ ID NO: 5488 - DNA, 23 bp, Artificial Sequence
  Synthetic Polynucleotide
ccataattrgtaccagctactgg

SEQ ID NO: 5489 - DNA, 23 bp, Artificial Sequence
  Synthetic Polynucleotide
gaaggactrcaggggagagaggg

SEQ ID NO: 5490 - DNA, 23 bp, Artificial Sequence
  Synthetic Polynucleotide
tgcrggcaaagaaggtaggccgg

SEQ ID NO: 5491 - DNA, 23 bp, Artificial Sequence
  Synthetic Polynucleotide
aacttgcrggcaaagaaggtagg

SEQ ID NO: 5492 - DNA, 23 bp, Artificial Sequence
  Synthetic Polynucleotide
tctgttcrcactttctctttcgg

SEQ ID NO: 5493 - DNA, 23 bp, Artificial Sequence
  Synthetic Polynucleotide
cctgactccacagcatgttygag

SEQ ID NO: 5494 - DNA, 23 bp, Artificial Sequence
  Synthetic Polynucleotide
tactggrgaacggcaaccacggg

SEQ ID NO: 5495 - DNA, 23 bp, Artificial Sequence
  Synthetic Polynucleotide
ttactggrgaacggcaaccacgg

SEQ ID NO: 5496 - DNA, 23 bp, Artificial Sequence
  Synthetic Polynucleotide
ctgtctctrggagtcctcagtgg

SEQ ID NO: 5497 - DNA, 23 bp, Artificial Sequence
  Synthetic Polynucleotide
ggcggcccrcaacgtcctgctgg

SEQ ID NO: 5498 - DNA, 23 bp, Artificial Sequence
  Synthetic Polynucleotide
ccgtgacctggcggccygcaacg

SEQ ID NO: 5499 - DNA, 23 bp, Artificial Sequence
  Synthetic Polynucleotide
ccttaaaggattacyttatcaag

SEQ ID NO: 5500 - DNA, 23 bp, Artificial Sequence
  Synthetic Polynucleotide
cccacatcagaatccatyggtaa

SEQ ID NO: 5501 - DNA, 23 bp, Artificial Sequence
  Synthetic Polynucleotide
ccacatcagaatccatyggtaaa

SEQ ID NO: 5502 - DNA, 23 bp, Artificial Sequence
  Synthetic Polynucleotide
agcrccgtttcacgcagtccggg

SEQ ID NO: 5503 - DNA, 23 bp, Artificial Sequence
  Synthetic Polynucleotide
gagcrccgtttcacgcagtccgg

SEQ ID NO: 5504 - DNA, 23 bp, Artificial Sequence
  Synthetic Polynucleotide
ccccatcaacccatayaaggacc

SEQ ID NO: 5505 - DNA, 23 bp, Artificial Sequence
  Synthetic Polynucleotide
cccatcaacccatayaaggacca

SEQ ID NO: 5506 - DNA, 23 bp, Artificial Sequence
  Synthetic Polynucleotide
ccagtattcctgggctaygacca

SEQ ID NO: 5507 - DNA, 23 bp, Artificial Sequence
  Synthetic Polynucleotide
ccatctgaaagaacacctgygaa

SEQ ID NO: 5508 - DNA, 23 bp, Artificial Sequence
  Synthetic Polynucleotide
ccccctgccaggcacyagtgggt

SEQ ID NO: 5509 - DNA, 23 bp, Artificial Sequence
  Synthetic Polynucleotide
cccctgccaggcacyagtgggta

SEQ ID NO: 5510 - DNA, 23 bp, Artificial Sequence
  Synthetic Polynucleotide
ccacatccgagtgcacaygggcg

SEQ ID NO: 5511 - DNA, 23 bp, Artificial Sequence
  Synthetic Polynucleotide
ctgactrgttgttctcaatgtgg

SEQ ID NO: 5512 - DNA, 23 bp, Artificial Sequence
  Synthetic Polynucleotide
ccttcctagcacagcggyaggtg

SEQ ID NO: 5513 - DNA, 23 bp, Artificial Sequence
  Synthetic Polynucleotide
ccctaactgaaaccyagcctcct

SEQ ID NO: 5514 - DNA, 23 bp, Artificial Sequence
  Synthetic Polynucleotide
ccttctgaaaacattyaagatat

SEQ ID NO: 5515 - DNA, 23 bp, Artificial Sequence
  Synthetic Polynucleotide
gcagcrgtgaggccagatactgg

SEQ ID NO: 5516 - DNA, 23 bp, Artificial Sequence
  Synthetic Polynucleotide
ccagctgcctgaactgcggygcc

SEQ ID NO: 5517 - DNA, 23 bp, Artificial Sequence
  Synthetic Polynucleotide
ccggccctccctgcggctgyatc

SEQ ID NO: 5518 - DNA, 23 bp, Artificial Sequence
  Synthetic Polynucleotide
ccctccctgcggctgyatcgcaa

SEQ ID NO: 5519 - DNA, 23 bp, Artificial Sequence
  Synthetic Polynucleotide
cctccctgcggctgyatcgcaag

SEQ ID NO: 5520 - DNA, 23 bp, Artificial Sequence
  Synthetic Polynucleotide
aaacccrgccccagctcccaggg

SEQ ID NO: 5521 - DNA, 23 bp, Artificial Sequence
  Synthetic Polynucleotide
caaacccrgccccagctcccagg

SEQ ID NO: 5522 - DNA, 23 bp, Artificial Sequence
  Synthetic Polynucleotide
cctgtrcccccggtgcccccggg

SEQ ID NO: 5523 - DNA, 23 bp, Artificial Sequence
  Synthetic Polynucleotide
acctgtrcccccggtgcccccgg

SEQ ID NO: 5524 - DNA, 23 bp, Artificial Sequence
  Synthetic Polynucleotide
cccccagaccccacyggggagaa

SEQ ID NO: 5525 - DNA, 23 bp, Artificial Sequence
  Synthetic Polynucleotide
ccttcccccaggggagacycctg

SEQ ID NO: 5526 - DNA, 23 bp, Artificial Sequence
  Synthetic Polynucleotide
cccccaggggagacycctgctca

SEQ ID NO: 5527 - protein, 9 aa, Artificial Sequence
  Synthetic polypeptide
DGLHAGSPA

SEQ ID NO: 5528 - protein, 12 aa, Artificial Sequence
  Synthetic polypeptide
VERLFGYDWAQQ

SEQ ID NO: 5529 - protein, 10 aa, Artificial Sequence
  Synthetic polypeptide
DGLHAGSPAA

SEQ ID NO: 5530 - protein, 16 aa, Artificial Sequence
  Synthetic polypeptide
VERLFGYDWAQQTIGC
